United States Patent 10,407,724 (METHODS AND COMPOSITIONS FOR SCREENING AND TREATING DEVELOPMENTAL DISORDERS) - sequence listing, part 16

SEQ ID NO: 264 - DNA, 3322338 bp, Homo sapiens (residues 1-1,661,169 of 3,322,338)
atgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaccccgtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcacaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggtgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgatacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggcgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagaggcattgggcagatggcatgtggccatttccagcagtggggcgcagtgctcagggagactgcagcatcctggagccctgccagccaggagggactgttcccattgcgggcagaatctgttacttgcaatcagaagaacttcaactaatacttgttttttgcctgtagattcaattgaccttgggaatgttgcttaaactcgcctttcactttcattttcctatcagtaaagtgaagggtcatatccacattagagccatcagaggagcttattaaaaatgtccaggcctcggccctccctggagatatgaattcagcaggtctggggtgaggcccaggcatcttggttggtttttttttttttttttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggtttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacacccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttctttttttttttttttttttttttgagacggagtctcgctctgtcgcccaggctggagtgcagtggcatgatctcggctcactgcaagctctgcctcccaggttcacgccattctcctgcctcagcctcccgagtagctgggactacaggcgcccgctaccacgcctggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggttttttgttgttgtggggttttgttttgttttgttttgtttttgagacggtctctcactctgtcacccaggctggagcacaatggcgcaatcacagctcattgtagctttaaacttctgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtctgctctggctgaaggcctccttttccttttctttttttttttttttttttttgagttggtgtttttgcccttgttgcccaggctggagtgcagtggcgcaatctgggctcactacagcctctgccccccgggttcaagcgattctcctgcctcagcctcccacgtagctgggattataggcacctgccaccatgcctggctgattcttatattttcagtagagacaaggtttcaccatgtttgccaggctggtttcgaactcctgacctcaggtgatccacctgccttggcctcccaaagtgctgggattacaggcattagctactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcgggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtgtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaataaaatcttgtacataagccagatgtgttcaacaagtaacagcaaaactggtcccatgaaactgccccttccacaggggccctgaggcacctctgcaaggccagggccccacaggcgctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagagctgggattataggtgtaagccactgtgctcggccttttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttggtcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttagtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggcagttctgggtgggcagaaacaagtgttttgtttgcagttgaggtttccccaaaacccagcatgtgtgggtgctcatttgtcgaacaaatgatcacatgcctccaattagaggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctccatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttccagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagctagcggtggggacttgccttgagtgcgctccaggtggtccctggggactcggtcctggcacccctgccctcctggattgcatcccacagccctgctggccgccccgccccagcctccctgctgtgacaggggcaggggctgcggtgaccctgcagcacaggcgcggctccctcggatcccttggatctcaccggtgcatctgaggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggtaacaagagcgaaactccgtctcaaaaaaaaaaaaaaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccacgagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcccggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacattctggagacaagtgaccatctcccccgtgagactggcactaggggcaggacgtggcctctctgcctcctgcggggcccacactggctgctgcatgctgccactaacatgtccccagttccggaagtctcctgtcctttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccaggccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggggctctcaaagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgcgcccaagctcccagctccatctgtgcccaccccacaggctgtgtgattgacaagtatgtgattggctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattcagttgtctctaactactctttgttatcaaggctggttgagtcaaatatcacaaagtagacaccaatgacttcttaaaaatcatatttacaaagtacaatgggggaaatgcttatactacattaaggttaaaaaaatactaaattgtgtaactgatctggtttcatatatatataaatatacacagaaaaaaatgtaatatatatctgcacagaaaaaagctgaaagaaacatatgccagaatgctagcagtgcttgtatgcgtgcagatgacgcactcagtcagcgcctttacttgtacgtgagcgcttaggggccctgtctctggggaccatgtggggcggtggggcgcttgagacagtgtttccctgcatcgtggccggacctctctactcaatccccagtgttctacagtgaacatgaattttataagcagaaagaaattacttttaagagccaggcgcagtggctcacacttgtaaccccagcactttgggaggctgaggcgggcggatcacaaggtcaggagttcgagacctgcctggccaacatgctgaaacccagtctctactacaaatacaaaaattagccgggcgtggtggccagcgcctgtaatcccagctactccagaggctgaggcaggagaatcgcttgaacccaggaggcggaagttacagtgagctgagaccacaccattgcactccagtctggatgacagagcaagactacatctcaaataaataaataaatacataaataaataaattacttttaagaatcaccaatagaaatctgtctttccatcttttttttttttttttttgagatggagtcttgctctgtcgcccaggctggagtgcaatggcgcaatcttggctcactgcaacctccgcctcctgggttcaagcaattctcctgcctcagcctcctgagtagctgggagtacaggtgcctgccaccacgcctggctaatttttttatttttagtagagacggggtttcatcatgttggtcaggctggtctcgaactcctgacctcatgatccacccaccttggcctcccaaagtgctgggattacaggtgtgagccaccgcgcccagcctttccttccatcttgattgcagtggtgattacacacatgtagacattcatcagaactcatcaaagtatacacttaagtctgtgcattttattacatgtaagtaacacctcaatctgaaaagtatcagggcaacaccacacactgcagaggggcagggctcctccggcagttactcacttcccttgaaacagaagctcaaacatggagtagtcttctgtgactaaacttgttttccgccctcccaacttccaggaagaaccttcttctgaataggatttgaggtaacttaggaaactgctctcaatacggaattttaaagttggtgaggaagtcgacagaaggggaagtcacagtaggaaaatcaaggtactatcaggatgaagtcagcacgcagagcaaggccagcgaggcccaggcgccaggccttggtccctgcccacctcacccaggccagccagacagcacggactgccctacaaggtcacctcagagagatgggggtgttctctcactgctggcttttgatgagcccaggagggctcagccttcactatcctccctaacaggcatttggggtgcagagatgctgacgcctgaataaggttgggattcggggcccttgggaacactgggcacctggtgggtgggtggaggggcaggaccggctgcagccatgtttcccttagaaacagactgctggaattaacgaactaaacaaatgaaccaaggtgcttcaccccccaaaaaagtgagttttgttctgcgtggagcgattgcctttgggaagccaccaaggccacctgccaacaggcaaatgctgtgctgccgtctgcctggctgactccggccctcccagtcctgcaagctcatggccaggacgataacgatgacaggggcaacaccatggtcctcgctgcccttcctggggcaggagggcccagaagactgataagctaaacccagggcctccctcggctgcttatctgcccagcacctttcctctaggtcctctcctcccaccagtacaggggtctgggagggggttgcagggggtcctgaaccacagatccctggagactcagtgggagcagctgtactaggaatcaggcaccactccgctgctgtaagtcttcgtgagagccactggccagcttcctctgacttccctgtcccctcacccaaatcgatgacatcaggagctaatggcccaggctgccctcctgctgcagtgcccataattcttccggcaggccccgccctgcactccacgaccagcctgggttcttcatcctggtaacctgacaatggatttcgtggggcccactctcagtgcccgccagcctgtgtcctgcctggccaggcaatgagtaccggcggcaggcagctgcctcacccctgcatgacccccccagcccaggggactcaatggcgctgtcatcaaaggggcagctgtagatctaggagggacgtggagggggctagccctgggcctctggcattgtggaggctgacctatagagaacagagctggagctggggagacatgaagtctgcacatctagaccccagtgaggagcccaggctttctaggcacaagccccatgggctccccgggcccagcccctaagaaccacggcagctgcgccaggccactcctgtctccacttccataccctccaaaggagaggcacctcccccccccatggcatctccaatctgaggacctgccacctcccagaggaccggaggccctgatgccccaagaattgggcttggaaagatgttaatatccactgccccaagtgccaaggttcagaggcactggtccaggacacacagcagcggggaagtggaaccctcactccagcctgcagtctgggctctgtcactgtgctgtctctccatccttccctccccacaaccagggctgtaggcccacctaacacaccacacacttcccagaaacaggagtcacatccttttcagggctggtagggtggctgaagatggcccaaaacctcctgaatggaaaaaccttgatggggagactgagggccaaggcagaggtttgtccaaggtcacccccagagtggcggatccaggaccctgggcaagatcttcctactgtccaggcctctcccccacctctcttgtgtggcccagcaccctggactcctccatgcccaggtgtgctccccccaggcacgctgggggcagggtgggcagcaggtgccccccaccaggatagtggttcttcctcctgcagaccttcagccctctgctcctggcaggacactgtggccctcctgcccacgttggtgcgggttgaatttgacggcccagcagaattcccaggcagggcagcctggctatcctccctggtgtctcggctctgagagcggagacccagcctcccagcctggagttgtggtgaattcgcaaacaagtctccatctccagaaccttcctgaagaaaacagctctccaggctggggcaagaagcctgtccctacagtgatacaaccacccctcaataaccccgggcaccacctggcacccactgggggccaccagggagcccaccaagcccactccgggcttggacagagggcaggcctggaggaaggcacatccaaccccactgaccggcatgcacctggggccaggggcctgctgccactgcagaggtgagaagcaggagcagcaagacctggtgcccattagtcatgggggaaaagcaaaagggggagacagggacaaatccaggcctgggtgggctgcctgtcagggggagtgatatccaaggaggaactggtggtcagagtggggtgggggatacccggtacaatttgttcatgcctcaacaccagccaccgcgggcctgccagccctgtgtgccctccctggcccggagtccacagggtgcaaaaggctgaccgcacaggacctcccgtgagaaccctacgctgcagagctcgttctcttggcttccaggcctttttatacgctgtcctgctgcttggacatgccagtccccacccctgcacctaccgagctcctgcggcactcagctgtcacccatctgggacgcacacctgtccgaggctctagatcaaggtgggaggttagtcctcactcccttcaggggctggacagcgagctgaaggcccgagcccagctgcacccagaaaacctgccacttggaactcacctgaccatccaagcccagcccccagtgcatgcgacagatgaggcagagattgtgccgtacagagatcaatatatataaagtgccggtacaacgctctgaaaaatagttttgtcccaaaatccagcgcctagggtgctccgggcctagcctttgccagtgaggtccaacggctgcaggaatgggggcagcggcagctcgtccagggcctcggggaagcggcctggagagatggcggtgaccagcacctgcatggcgcgcgcgaagagcgagggcggcgccaggcccgccagccactggaacttgtcctcacccagcagccgctgccagcgcggccggtcgcccagcagctcctggcgggccgagccggcggcacccacgggggtgtacagcgccaggaggtccagcagcagcaggcggcgctggcgcggctccccgggagctgaggcgggggctccggcggcggagggagtggccccggcgtcgcggcccagctggcgcagcagcagctcgagaggcgtgaggccgccgccgtcccgcagaccgggcgaggcgccgtggcccagcagcaggaagaggcactcggggcgcgccagctcacaggccacgtgcagcgacgtgccaccgccctccacgcggctgcagccacgccggtccagcacgcgcgcccgctcctcggccgggaagtcgcgcaaggtgcgcaggatgcggcgcagaatgcccacgcggttgtagcgcactgccagcgccacgtgcggcccgggagccgcgcagcagcggaagccggcactgggcggtgcgagcgcgcgccgcgggaacgtggccagcaggtaatgcgcgtacgcttggtggtcgtgcacgagcgcgtagagcagcgcctcagagggcgagtaggcggcggcgcgcccgcgctcgtcccagtggaaggcctcgctggcgcgcatatcctccagcagccacacgggtagcaggtcgcgcaccgcctggtagaaggcgaacgacgacttgcggcactgcttctgcgctcgcgagcgcgccgcgcccgaggcctcgggcccgccgtccgcgccacccccaggccgccgcgcgtcccacggcatgctggcggcggggcgttcctgggcctcaaggcatggatcccgcgaaggcacacctgcggggaaaggaagaggccacggtgaggcgcggggaaactggggaggcccggggactcccctctgcccctcacacagcccctccggtcctggcccaccaggcctgtacctacctccagcctcggccaggcccttccagtcaccctacagctccatctctccgacgcccagaaccaccgcctccatccttgatctagctgtacctgttctccctccttgaaactgacttgctctctggcacctctgctggaaatgcccttgctgcccatgccctcaaatctcccctcccctctccaacccagggacccactggaagagcttctgttcccacctaagccaggttcatacgaccccaaataaagaaaaggccagggaggggatgagaaagcttgggcccacatctcaagctgaggcaaatccactctccagcccaagcgcaaccctgaccctgatctccgaccccagaccacttggaggcccctggagcctcttcctgggctgttcagaggcatgatccagactcagacctacctggttcctgcaccgcgatcacctagttccggggatgtgggtatatcacagtccctggccgagcctcagctttatctgtaagaaaggggaggggtggacgacggctgtgcgggcggggtgagcctggggcgtggcaccagccctctatccaaacatgtttgcttacacgttagctcctgggaggagataggagggtgaaaacaacctggagaccggtgtgcaccgcactgcacagtctgccatcctcttcaggtcccatacctctcttgatctccccgactactagatgaagcgggtactgccatcccactttccagcagggcacaagcttctccaattctccaaggtcagcaagccacggcagagccaggcctagaactcaggtcccctgcgtctcagtttgggctcattccagaattggtggggacccccaacccacaggcaatcgagcttaggccctgaccctgccctctgagtccccagccccgacctgagcctaggcgtctgacctctggctccgtcccaacctccctactgccttctttcaagggtaagcccttggtcacaaggggcctgggacagaaggcaggccgcgtccacacacactgactgggtcactatcactggcagtaactgagttaaagagagcggcgcggtgcgggtaggctgtggcccgtgggcaacaccgtgactggagccccttccccaagcctgggcctccgggccccagatatgccctgtgccggcacgcgtggggcgccgggcgggttacgtaaagttcggcctccccacgtcaccgggcagagtcacggccgcggctcgtgaataagggggttgggccatcgaaggcagcgccgcgcccggggccacccgccacctcctacccgtcccctcccggcctgcacggccagacgtcgggcggcggagggtcgcggggccgagcggggcgtccgcgcgcaggtggccggcgcagcgagggctgcacctgcgtgcgcgtgtgccggaggaggagggggcggcggccgcgggcgcggcgcgggggacggggactcaccatggggggcgcgggggccacaggccgggcgtccccgcccctgccgcggaccggagcgcgcgctgtcccccgcgggcgagcgggcaaaggtcccacgacggacgcacgggagggagccaccgccgcccgcgcccgccgcagccgcgctctgagccgccgcggccggatcgcagggcggcggtgccgtcgccggcggcgggcggcgggcggcgggcggcgggcggcgcagtgcggccccggccaggcaggacagcgggaccgtccgccgccgccattggcccgcgccgccggcccccgccaccacccattggccgccgcgctgcaccattgttacgtcactggccggcgggcggggcgcaccgctggacccgcggaaaacttcggagaaacttgagggagcgccggcggggagaacggagaggaggggcggggccgtggcgaaaggggcggggcgttgatgggcgggggcggggctcccggaacccgagctgcgggcgaagaaaggctccgagctccgagctgccctagcccgggagggcgccgctgctctgcgaactcgggcgcgcgcgtaggtggcccgccctccgccgtgcgtgactttcctcgtcgcgtccagctccccttttctttgaccttacgtgaccttgggaaaaacctccaggctgctaccccatctgcacatgggagggccgggggtaggagccgcgacccctaagggctccaccgccttctgcccggccagggtcgtgcctggcgcgcccccgctccagctgacccgcgcaagggagggaggggcggacggatggggacagctgtttaggagcgcgcactgcgcccatctcggcctcaacactcatgtttccacttcgtttcacgaccaccagccacagtggacacgatgatccccagttcacccgccagcaaatcagggctcagagaggtggcctcaaagagaggagcggccaggagggaagccgggggtttgccctgcggttcttcccacatctgggcgggatagattcgattgggcctcggccacccccaccgtctccgtcgggggttccaaggtttggggtcatgacctagggggcttaggagcctgggtccatctcaactaatttatggcctcactcgcccccagcggctgggaattctaggcccattttacagatgtggacgcagatctggagaggggcaatgactgctcaaccccccacccatcctcccagacacgaccttccacctggaatccccccacacacgttctcagaggccaggcagccggggtctcatggtgaaatccccacattccatgcaggggctctttctggttccttccctagaatgctgtccctgcccttccagtactatctcaccagggagaccctcccactcccccactccgctccaaccaagcaaggcctctgcctcgccccggtgggaggggcctcgtccagagggcacgcccctgcacacacaatcagccctgtcctggcttctctgtgtgccccagccagtcagtctgggtggaagtcttacctgggccctctcaacagacctaggcaggcctctgtccccagcccaacgagctcaatcccttaagcacacacgccacagagcagtcctgagaggccaggtggacagtaccatgaggcagacaaagctgtgaggcccagagagggtcaggccaccccagcccaggtaggcactcacatgtatcctgcccaggctgccatgcatggacccaccagggggatgaccagaccccaccagccctgccccacctcagggcgggggacgttccaggccacgccatctctcccagggagtccatggcaactgccaagcttacagcagccaggttgtcagcaggagtaggggtatagagggcactgggcctggcatccgcacccgcctttgcctcagctccacatgtctcctcctgtatctaggcctatctccctagggcttctcccatctgccggttctggatgcctctgagtacgatggtggggagagcaaagtgagtgaaggtcctggagtcaacaatcggcctttgggagcccaaaccctgggggacatcttggggagatggtgcccatgtgggctgtctgtggctcaaggctcccctgctctcttgccctcttcgaaggctggagttgagatacagccgtctccatggctactggtggaatgagggtgaaagggcaccagtggatgccaggctgtgcactgggcctcagggcgggtctctctccaccccttgatgtcttccctgcccccgtgccctgacctgccctcctcactggggatcccagagggtttttttttttcccaagacaaagtctcattctgtcacccagactggagtgcagtggtgcaatctcagctccctgcaacctccacttcccaggttcaagcaattgtcatgctgcagcctcccaagtagctgcaattacaggcatgcaccagcactcacagctagtttttgtatttttagtagagacggggttttgccatgttggccaggctggtctcgaactcttggcctcaagtgatctgcctgccccagagacctttttctaaaagccaagtctgaccctgtttctctgctgcctagaagcttcctgtggacatggacatagccacaaagtccagatgggcagaaagaggcatttctggcagagggcaaagcaggggccaaggtctggagtgtgacacaaaggctgcagaggccacctgactggccaggtcccatggggcctggaatgcccggcaaggatcctggattttcccctgaggcccaagtggaggggttgggaagtggtttcactagtgaattattttagacacacatacaaagagcatcatgatgcctgggagcccgggacccagttgaaggagcaacacacggcagatcggaagccctgcgtgcctgtcccctccctccccagccagcctcagtgtgagtccgcgtgcgtctttcccactgtaagtgcaagtggcagcagacatagtaacactccctgccatggggctccacagcactgcctcacctcagcctcttgcctttttctcctgaggtcacttttagatccagccccaggggaaccccctgctttgggttgcagccgccatctctgctgcagtgtcttctgatgaaagctgtcccctgtgggcatgagtgtggacatgctgcacctcctaaggcagcagtgccaaggctgatggtgccctccacggtggtttcatggcatcgctgctgcactagaggctgcccagggacgtgtgaacagctgtgaaggggcaggttcctcagggagggaggatgggctgcggggagggtggctggggcaggggaatgggcagagcatgacttccaaacacctaggaagccccaggtggagggcggaggggggtcttgccatcttgggataggagttgacctttgaccccatcatgctcctgctgggacctgacccaggcacactcctcttcctctgggagggcttgtcccaccagggcaggggtctgtgtgtgcccaggcagggagccacaggcagtagggggaggctggggctgcaagcacagaggccccggaaagtgtgtgaggacgctggggagtgggaagggccctcggaggggtggtatggccggcttaggttttctcgacaactctagttgagtatgcactgcagggagacggagaggccgcagccactgaagccaactgtgctggagcaggcggagggcaccaggggtccctggagagaagtgccgcctcctgccaggcccctgacctataggtgagggtgtgagcagaagaggagaatctaggaggcctcccgggtattaggggaaagctgagcacctggaagatggcagagccaagaggtgtccatggccctggagatggggtcatgagtataaagagggcgcttggagtgtgaggcaccagggatgggaggtgagaggcccgaggccccagccggggcttccaggaaaggaggtgggagagggtcttggggccaagaaggcacagggcttcccgaagccaaggtgtcccaaaaataagggagcggtcggctgggacagattcagatgtggtggctcacacctgtaatcccagaactttgggagtccgaggcggacagatcacctgaggtcaggagttcaagaccagcctgaccaacatggtgaaaccctgtcgctactaaaaacacaaaattaggcctggtggtgcatgcctgtaatcccagctactcggtaggctgaggcaggagaatcgcttgaacccaggaggcgggaggttgcggtaaactgagatcgcgccattgcattccagcccgggcaacaagagcaaaactcggtccataggtcacagtgccctttacagaatgtcatggggttaggggagaaacctgtttggagagagttcaggagcaagcggggagcgggatagagctgtgaggacaggagaggaaggggcaggcttaaagaatgaaacggtggagataacacacgtgcacatgcatgtatgtgcactcagacacgtgggtaggcccacacatgcatctgtgcatcatgggcggcacgctgtgtgtgcatgcgtgtgcgtgggcagcatgctgcagcctgcatttgtgtgtcctgtgtgtccattatgtgtgcagtgcgctgatgggcaaaaacgctgacgatgcaggccagctgataacctggaggaggccggctggagtggggcctgccacacgtgaggggtaccctgggctggcgacatgggcagttcttcttgggggggggcagcatgttgggcacagacacagaggagggcacaggtaaaggtgctcggagacatctgctctggtggcttctattttcaaggccatctgctgagaataggaaggggtggatggtggggagggggctggaggagagggcttcatttgctgactacactgagatcctctctgacctgagcccctgccacccagccaggcctgcggagcctgccatctgcgcaactgggatgggacaggtggccgcggccaggaaggcaccacaggtgcaggcaggagggcaggcagcttcctcagggaggggctggcaccagacatgctggatcccgcctaatcagccacccaccagtggtgggactgggctgagcaccagtcacttatctgtgacatgggtcaggtggattttgggtgtcagagggaaggtgtttcatgtggcaagactggcaaggccagcatgcggagtggctaggaccgggtgagagcctgggggtgtcccaacacttgccccacctcatgcaggttctgtccttccactgcctggccagaccagaccaaagctcacctggcctttaagactggcacctgcaccaggagccactactactccctcctacggtggcaggctgggctctgccccaccgcgtctgcagccccatcagctggtctctcaaggctcagctttgggatgccagtacagaccaaagacaggacaaaaccagtggagacaagggacatcctgggagccgaagggtccagcatgtatagccaaggagtggcgtctcaagtgtgcagggagcccccaacatagctggaagatcggcccgggggaagatgggcgagggcaccataggttatccacatgctggccaacagacacgtggagatagacattcagctttgccaggaatcagcacgtgtacaggctcctggcgaaaactgagtagactgggaaagcccgtgctggccgggttaggactcaggcacttgccccaccagcagggaaaactcacatgcttgggggcccggcagatccttctgtaggcatcttatcacaggtgaatacctgcctgtgtactaagttacatatacaatacaatgctcactgctgtggattttgttctcttgcttttttttttttttttttttttgagacagggtcttgctctgttgcccaggctggagtgcagtggtgcaatcatagctcactgcagcctcactctcctgggctcaagtgatcctctcacctcagcctcccaggtagctgggactataggcacatggccaccacacacaaaaaataaattttttaatttttatttttgtagacatgacaccaggtcttgctatgttgctcaggctggtcttgaactcctgagcttaagcgatcctcctgcctcaacctcccaaagtgctggaattacaggtgtgagccacctcaactgacttaattatttaatgtttcataaaataatttagcagccgggggcagtggctcacacctggaatcccagcacttcggtaggctgagacaggcaggtcacctgaggtcaggagtttgagaccagcctggccaacatggtgaaaccccgtctttactaaaaatacaaaaaaaaattagccaggcatggtggtgggcacctgtaatcccagctactcgggaggctgaagcaggagaatcacctgcacccgggaggcagaggttgcagtgagccgagatggcgccactgcactccagcctgggtgacagaacgagactccatctcaaaaaaaaaaaaaaaaaaaaaaagaatttagctgaattttgtattttctttctttctttttttttttttgagacggagtcgcccaggctggaagctctgcctccccgggtcacgccattctcctgcctcagcctcccgagtagctgggactacaggcgcccgccaccacgcccggctaattttttttgtatttttagtagagacggggtttcaccatgttaaccaggatggtctcgatctcctgacctcgtgatccgcccgcctaggcctcccaaagtgctgggattacaggcgtgagccaccgcgcccagccttatatttcatgtctatttcattattaaagctttgaagagaatacaagtgcataccaagtactagggagatagagtcactgctgcatctttaataaggaaaacctggaaactacctaggtgaccatcagaaggggtatggctgacatggtcatggcgaagcctgctgtgactttgctgcagcttgaagagcagtgagtcagaaggggcaacggagaccggagggcctggcccggcccaggtcgcacagtgcagggcagtcccaagggtgacagcggccagtgcgcgggcgcgccctctacccacatgccccgacccgccgggtccctgcgtccgcaagatcactttccgggcccgaggcggggaaggggccgggacatgggttggggactgagcgccgctgaactgcgccatggtcggagagagtttgcaggggcggaggtgttccctggtcggaccctgccgaccgccctcggggagaggcgaggccctggcccgtgacggctgggtccgggcctcagtatccccatccgctcaggggaaagcgggcggcagcccggagcccgaccccagcgcccagcgcggcccgacaccgccccctggcggccgcggacgtcactgcgacccgcagcctccgccgaagccgggcgagggacccccgacccgggcgcaccaggctgcgggtgcgggggcggggacgcccagcgccctggccccgggggcggggttcgcgggctgagtgcccactccgctctcccctcgccccgcggcctcggcgggccccccgcccaccagggtctccacctccccccgggtgaaatggccacagtcccgccatccgcgccgccgccactgcgcctgcccccggctgggccgatcggaggtcccggcggggcgggcgaggcaggtggtccggcgggccccttccgggttcccctcccccagccggagtccgcggaccgcgctgggcgcagggagggggctgtgcgcgcctccgcttcccggccttcccagcggggacgagcgccgacccccgcccagtcgggagacgccctcaaggtcccaggctctgcttctgcccgcccgcggcccgcggactgcgggtgacagggtccccggtccgagccccatctccctaggagagcggaccccagcgctcctgtaccctccacctggtggccgtccacgcagcccggcctgctcgcgcgtcccaactgccacttcccttgccttccccagccgcacgtctaccaggctcctgtgtgtctgcctggctgggacttccgcatactccaggcccactttacaggtgcagatgctgaggccagagcgcctcaggagctggatgcaggggagagcgtgcgggcagtgtggggagagactcggcctagccttccattgcagctcctatccctgctgcgccaccccctcggcctgtcatctgtccccatccaggaacccccaggacactgtcagcagagcccactgagggtccagtgctgtccaggtggcggcatcaggattcccaggagccagccctcactatgccaccctatgtccgtatgtccagcagggatctgagggcctggaggggtgcggaggccctgccaggagatgctttcctcagtgcccattgtgaagggagcagagggctgaactggaaggggcttcctggccccaggagggcagtgattaggtaaactgcccacccttcaaaagtgatggacaggaaggggaaaggtggagggtggaggagctgcaggttatgccggtgacccctgagagacaaggagatctccacagtgtatcagttctcttctgctgtgcaacaaacaaccctgccagggtggctttaaacagcaatgatgtaggattgtttgcggttctctggattgactggatggctcttttgcttcctgtggcgcccgctgggatcactctacagctgtagggatctggaggcccaactggagtgaaatgtccaagtggttcatccacatggctacagttggtgctggttgccagtgggagctcggctgcctccagcatgggctgccaccctgcttcggtgctcctttgcttggcttctccacgtggctaacttggtcttcctcacagcatggcaggacaagccccagtgtgcaagagctcattaaacctctgcttccatcatgctttctaatacctcattctccaagacaagcccagagttcacgtggaatgagactcacaaaggcatgaatctcaggaagcctggtttattattatgggcatcacagcttagcacaatgatggggaagcagtggggacagatcgtagacagcagaccttccagggccagaacaagcagggaaggctcctggaggaggatgggactggctaaggaggggctgggaactctcttccttctccctgaagctccaaatcctcagggcctggggaggttggaggagcaccaaccactaaatcaagatacaaacgctcaaggctcaaactcctgaactcaaggcggatcacctgagttcaggagtttgagaccagcctgggaaatatagtgagacctcatctctacaaaaaataaaaataaaaaagttagccgggcgtggccaggcgcggtggctcatgcctgtaatcccagcaccttggaagcccaagacaggcagattgcctgaggttaggagtttgagaccagcctggccaacgtggtgaaaccccatctctgcaaaaaatacaaaaaaaaaaaattagctgggcttgatagcaggtgcctgtaatcccagctactcgggaggctggggcaggagaattgcttgaacccgggaggcagaggttgcagtgagccgagatggtgccattgcactccagcctgagtgacagagtgaaactccatctcaaaaataaaataaaataaaataaattagccgggcatgatggtgcctgcctgtggtcccagatactcagaaggctgaggtggatggatcacctgagcctgggaggtcaaggttgcagtgagccgtgatcatgccactgcactccagcctgggtgacagagcaagaccctgtctcacaaaaaaaagaaaagaaaaaaatcccaacataccgactgttgacaagaacatggagcaactggaactctcatacaatcccccagtgggaatgcaaaatgatgcaacaacttggaaaagcttggccatttcctaaactcatcataggaaccagcagttccactcctaggtacctgcccaagaaatgaaaacaatattctttttttttcttttattttcttagagataggatctcactctgtcacccaggctagagtgcagtggcatgatcacagctcactgcagcctcaacctcccaggctcaagtgatccttccacctcagcctctcaagtagctgggactacagggagcgacacaacacctggctgatttttttatttttatttttgtggaaacagggtctcactatgttgcccaggctgagtcgaactgggttcaagcaatcctcccgcctcagcctcccaaaatgctgggattacaagcgtgagccaccatgcctggcctgaaaacatctctaacacaaagatctgtatgtgaacgttctgtgagataaagtagcacacctaggaagccaagcatgctcctttctgtttgcagcacagtttcacaaagccctacctctgtgaccacctgcagctctccagaaagttgctttgaagacaaaacgcgacagagcacacagtccccctccccacgcctctggcttgagttgctacattctctaaaagatccatgaccctagccttgcctttccctcctcattacatctggttagggccgggcgtggtggctcacgcctgtaatcccagcactttgggaggccgaggcaggcggatcacgaggccaggagatccagaccatcctggctaacatggtgaaaccccgtctctactaaaaatacaaaaaaagtagccgggcgtggtggcgggcgcctgtagtcccagctactcgagaggctgaggcaggagaatggcgtgaacctgggaggcggagcttgcagtgagccgagatcgcgccactgcactccagcctgggcgacagagcgagactctgtctcaaaaaaaaaaacaaaaaaacatctggttagtgatgatgcttctgtgatctataaccagatgtattcttacccaaaccttgatgtaactctgcctcagtgtaacttctgagcaagtctgatgtgattttgcacgtattgaactcccacaattcatgtataactgtgagctgaaactattttggagcaatctaagaaaacctcaccaaggaaatgttctgggctatcagcctctgggtaatgtcctcaggaggcttctgaatcaaactcactcttttttgttttttgagacggagtttcactcttgttgcccaggctggagtacaatggcacaatctcgactcaccacaacctctgcctcctgggttcaagcgattctcccgcctcagcctcttgagtagttgtgattacaggcatgcgaaaccacacccggctgatttttgtatttttagtagagatggggtttctccatgttggtcaggctggtcttgaactcccgacctcaggtgatccgcccacctcggccttccaaagtgctgggattacaggcgtgagccaaggtgcccagccatcaaactcatatcttttttttttttttttttttgagacggaatcttgctctgttgcccaggctggagtgcagtggcgctatcttggctcactgcaatctccacctcccgggttcatgccattctcctgcctcagcctcctgagtagctgggactacaggtacctgccaccacacccggctaatttttgtatttttagtagagacggggtttcaccatgttagccaggatggtctcgatctcctgacttcgtgatccgcctgcctcggcctcccaaagtgctgggattacaggcgtgagccaccacgcccggcccaaactcatatctttaaaagctttctttctttctttctttcttttttttttttttttttttgagatggagtctcactctgttgcctggtctggagtgcagtggtgcgatctcggctcactgcaacctctgcctgccaggtttaagctattctccagcctcagcctcctgagtagctgggattacaggcgttcaccactgcatccagctaatttttctatttttagtaaagacgggatttcaccatgttggccaggctgatctcgaacccctgacctcaggtgatccacctgcctcagcctcccaaagtgctgggatggattacaggcatgagccactgcactcagccttttttttttttttctttttttttttttgagacggagtctcgctctgtcacccaggctggagtgcagtggtgtgatcttggctcaccgcaacctccacctcccaggttcaagccattcttctgcctcagcctcccaagtagctggtactacaggtgtgcgccaccacgcctggcttttttgtttatttttgtttttattttttgagatggagtctccctctgtcacccaggttggagtgcagtggcgtgatctcggttcactgcaagctccacctcccaggttcacgccattctcctgcctcagcctcaggtgtccaccaccatgcccgggtaattttttgtatttttagtagagacagggtttcaccgtgttagccaggatggtcttgatctcctgacctcatgatctgcccatcttggcctcccaaagtgctgggattacaggcgtgagccactgcgcccagcccttttttttttttttaagtggagacggggtttcaccatattggccaggctggactcaaactcctgacctcgtgattcgcccacctcggcctcccaacgttctgggattacaggtgtgagccaccatgcccagctgcattttatttctttagtcaacatccatagcagcattattcataataccctcaaaatggaaaggcatatccattaactggtgaatagatgtataaagtgtgggatttccatacaatggaaattattcagcaataattattctcgccatctgcccaggcttgtctcaagtgacccacctgcctcagcctcccaaagtgctgggattacaggtgtgagccaccactcatggcctacatcaataaaactcttagagaaggccaggtgtgggtggctcacacctggaatcccagcactttgggaggttaagacaggaggatcacttgagcccaagagttccaggccagcctgagaaacatggcaaaacctcttctctacaaaaattttaaaaattagccaggcatagtggcacgtgcctgtggtcccagctactcggaaggctgaggtgggaggaccgcttgagcccaggagtttgaggcttcagtgagctgtgatcacaccactgcactccagcctgggtgacagagggagactctatctcaaaaacagaaaaaaagggccaggcgttgtgattcacgcctgtaatcctagcactttgggaggctgaagctggtggatcacgtgaggtcaggagtttgagaccagcctggacaacatggtgaaaccccgtctctactaaaaagtaccaaaaaattagctgggtgtggtggtgggtgcctgtaatcccaactactcgagaggctgaggcagaattgcctgagcccaggaggcagtgagccacttccctccagcataggtgaaagagtgaaactctgtcaaaaaaaaagaaaaagaaaagaaaagaaaggaaggaagggttcgcagaggttgcagtgagccacttcactccagcctgggtgaaagagtgaaactctgtcaaaaagaaaggaaagaggaggggaagggagaaggaggaaggaagagagaaagaaaaaaagagccagagcttgagctaagccttcagatgggctgtggcaggaaggaaggaaggagggagaaagaaaaaaagagccagagcttgggctaagccttcagatgggctgtggctggaaggaaggaaggaaggaaaggagaaagaaaaaaagagacgggagggagggagggaggaaggaaggaaggaaggaaggaaggaaggaaggaaggaagaaagaaagagaaaaaaagagccagagcttgcgttaagccttcagatgggctgtggctcagctgagacccggtcaatgctggaggcagccctgaaccttcccggtttcagcccccaaacccttggggcctgtgtgtggtcccagggccccggatacgcgagcctggatgtgtggcgccgagttgtttacagaaaactctccgtgagggaacgaggcctattttcaatgataaatgccccaaatcacaagtagttcaacccccaagtctgaattctcccaaactggagaaatcggcttatttccaataacaagctccaggctcaggggaggccagcccagccgcgcaggtgaagctgcaattagtgcagggcaattagggacgctccccgttcgggtggggcctggcccacggcggcgcttcgggagggaaaggcagagagggtgtgcgccagccccagccgcccacgaaccgctgggagcagacccctctctctggcctggaggggacacggtgccactgacttgagcctggaaccaaagggcggggtacccatgcacccctgtgctgagagattcgctgagagccgcgcagagggccccagagtccaaacaggacacccaggattgaggcgaggttaggaaacgcacagtacctgaggtcctcactttcagggctccctgagtgatgaaaggggggctgggagaaggcagaggctgcccgggagagaagagcagctttggggggttctgggtccccgcaccccaccccgcactaaccaactcccccagccccagatagaaggggagctgggcaggttctggggggtcagccccaggcaggaccgctccccaacacccttcccttggttaccctcaggtatggagtccagagtggagtcagccatgctcagaccttgaccccctttttttaaatttaatttttagtagagatagggggtctcactatgttgcccaggctagcctcaaactcccaatctcaagcgatcctccccccttggcttccaaagtgctgagattacggatctgagcctccacgcctgccctgagcctcgccctgcggctgcctgggctcctccccgcctccgccccggaccaccagggggcgctgtgaagcctgagactggccgggcttcaccttggacccgccaggagtccctgcaggagttgggagccccgccagccacagctacttccccgaccctcccggcttcccaccgctgattggaccaggcatgggcatctgactgaggggagcctatccataggctggccagtgatctatcagggctggcctagtgagaacacggccaatcagatgctttcctggaacccggggccaaagctgccccaggggagtgtggtagccgcaggcagaagggctagcccggagacaggagggggaggtccgaggaggggatcccggcgagggagacgcggggcgagtggcctgggctcctccttggcttgacccagcttagactttctcaaaccgaagtcattctcgctggctcctggcgactctcatcctgtccgctgtcaccctttcgtgattgacctgaaatcacttcgtcactgcagccgcaccctaagcattcatctcatatctgtgatgtttgctgtgctccttatgtttgctctaatatgggttaaaccaaattcaacaccatcaaaataatgttcttccatttgcacacccactttcacagtagcagcgttcccaacagccaaaaggtgggagcagcccacgggtccacggacgggtgaaggggtgagcaaacagtctatacggacagtggagagctctttaaccgcagaaagaaggaaattctgcatatgctgcaacatggatgaaaggtgaaccctgacattatgcggagtgcaataagctagtcacaaaaagacaaatactgtaggattccacttacattctgtgtccagagtagtcaaattcagagagacaggaagtagaatagtggttgccaggggctgggaggagccgtgaatggggaggtattgtttaatgggtatggagtttcggcttagattgaactgtacgctttttttttccttccttccttccttccttccttccttccttccttccttccttccttcctccctccctgcctcctttcttctttccttccttctttcttttccttccttccttcctctttttctctttccctctttccctcctttttctctttctctttccttcctttctttctttttctttctttcttcctttctttctctttctttttctttctctttcattcgtttgttccctccctttccttccttcctttctttctctttctttatttttcttttctttctttccattcctcccttcctccttctttcccctgaccatggcaaagacgtgaactgtacacttaagcatggtttaaacggtaagtgttatgtgatgtgcgttttaccaccatgtttgaaaaaggttcttctgtgcaccccagaacccatcctgcgtggggatccacagagcgcccagcccagcctctgcatggcatgaccaagagcatttgctcaccggggggctcaccgtggcctgagctagggcaaaagtaccaagccaggatggccctacccagccagagccggagactgaggggtcaaactggggtactttcctcgtctgcaaggagaactcatagcagtcctctttaaggttctttttttttttttttttgagaccatgactcactctgtcacccagcctggagtgtagtagcgccatctcagctcactgcaacctctgcctcccgggttcaagcgattctcctgcctctgcctcagcctcttgagtagctgggactataggcatgcaccaccatgcccagctaattttagtatttttggtagatactgggattcaccatgttggtcaggctggtcttgaactcctgacctcaggtgatctgcccgccttggcttcccaaagtgctgggattacaggcatgagccaacgcgcccggcccctctttaaggctctcaagggccctgtctgccaaggaagaaaatgccatcccaacccccagccccacccccacttccatacacacgttggccttagtggggactaaaagcagagaggaaatggaggcttagagaggtcgagtgacatgcccaaggtcacacagccacaaccggaagccagcaattccaatggcaaaatccatactctctctaaaactttgcttctgaactacaagaatgagagcctggcgagtgcaggctaggttgaggagaagccaccggacagacacagaacaccttccggcgcaccagccttccgtggccatttggagtgggaggtgcaaaattgagcaaatgcataaaacctaacttttgcatcacacaaggattcccatgttgcaggggtaccgcgtaacactcgcatggagttttttggtttgggttttttgttttgttttgtttttttgttttgttttgttttgttgagacagagttttgctcttttttttttcttttttttttttttgagacggagtttcgctcttgttgctcaggctggagtgcagtggcgtgatctcagctcactacaacctctgcctcccgagttcaagcgattctcctgcctcagcctcccaagtagctgggattacaggcctgcaccaccagacccagctaattttgtatttttagtagagacggggtttcaccatgttggccaggcttgtcttgaactcccgacctcaagtgatctccctgttttggcctcccaaagtgctaggattacaggcgtgagccaccacacccagcctcacgtggatttttgataaagcaaggttcttctgtgatagcagcaggcctccattatcctggtcaattggcctgcacaactagggaaacaatggtggaaaacttcgagaagcttgtgttccacctgccaccaatggagaaagcaccactccactgtgacatgcttcctgatgactcgctgaacagaaggatgcaccctcagccaccaagggtgtagtttgtgggtgcctcctgggaacatcaggttggcaacacaaatgccagcccctcaccctagagtgatttcagagtgtctcatctcttaactctgagtcacagagcggtggggaggaagacatggggcagggcagggcagggcagggctgggcgtggcgtggccactcatggagcagagggaagggtggagaggtgcactctgagtttgttgccttcatttgctttgttgatgaaggaggagcctgaggggcctggcagtgggactgaggctctgggccttcctgctcccctgggtttgacccagactccagctacccaggcattgccaggcagtatcctggggaaaggtgggacctgctgcttcccacgcctgccctgtgggatggggagggcttggggaaggtgctgctatgccctgagtccccggagccaaagactcccgagggtgacaagcagccctgcccgacctcaggcccaggggtgatggctgttggtggctcccaggctgagtcactgtagccttcccgtcactctctctgacacccagagactgggtcctgccatcctggggtaaggcagggggcaggaaggtgctttcgagaatgtagccctggccgggcacagtggctcacgcctgtaatcccagcactttgggaggcagaggtgggcagatcacctgaggtcaggagtttgagaccaacctggccaacatggtgaaaccactaaaaatacaacatatactaaattactaaataaaaaaaatactaaatacaaaaagtactaaaaatacaaaaaagtagctgagcgtggtggtgcacacctgtaatcccagctgcttcagaggctcaggcaggagaatcgcttgaacctgggaggtagaggatgcagtgagctgaaatcgtgccactgtactccagtctgggagacagagcgagactctgtctcataaataaataaataataaataaataaataaatacgtagctgtgccagaggcttagggaactgggagtgtcttagggaactggggacctaggaggggaggccacgtgggtagggctcccaccccactcacttcaactggacattctcagttcaggaagtgattttgttattgttgttgttgagcttctgagtaaaatttcctgtgaaaaggggtttagcaggcgggcgcagtggctcaagcctgtaatcctaccactttgagaggtcaaggcaggaggatcgcttgaacccaggagttcaagaccagtcagggcagcatggtgaaaccttctctacaaaaaaaaaaaaaaaaaaaaaaaaaaaaaaaaaattagctgggggttgtggcgtgcacctgtagtctcagctactcgggaggctgaggtgggaggatcacttgagcccacgaggttgaggctgcagtgaatggcaatcacaccattggactacaacctgggtgagagagtgagacactgtctcaaaaaaacaaaaattaaaaaaagaaagaaaaaggagttaactactaaaaatcatttctgggccaggtgcaatggcagagtcccagctactctggaggctgaggtgggaggatcatttgagttctgtaggtgaagtctgcagtgagctgtgagcacgccactgcactccagcctggacaacggagcaacaccctgtctgaaaaaaatataataaattaaaaataaagcctgggtgcagtggatcatgcctgtaatcccagcactttgggaggcctaggtggtcggatcacctgaagtcaggagttcgagaccagcctgaccaacatggagaaacccggtctctactaaaaatacaaaattagccaggcgtggtggcatatgcctgtaattccagctactcaggaagctgaagcaggagaatcacttgaagctgggaggcagaggctgtggtgagccaagatcgtgccactgcactctagcctgggcaagaaaagcgaaactccatctcaaaaataaaataaaattaaaaaatagccgggcgctgtggctcacacctgtaatcccagcaccttgggaggccaaggcaggcagatcacaaggtcaagagttcgagaccagcctgaccaacatggtgaaacctcatctctactaaaaatacgaaaattagtcgggcgtgattgcacgcccctatagtcccagctactcaggaggctgaggcaggagaatcgcttgaacccgggaggcggagattgcagtgagtcaagatggcgccactacactccagtctgggtgacagagcgaaactgatcccaaaaaataaataaatagaataatgaagatagaaatcatttggggtccctgcaccctacataaaatgtcaaatcataaaccccagggcctactctgaaccaagacctctctgttcctcactgtacctcctcagagaagaaactctggaagagcaagaaaagtgttagactcagagtcaagcggacccagtagaaaaccccagaaaaggacagctcagactcaatggaagcttatttttctctcattgtgaagatgtcggccgggcgcggtggctcacacctgtaatctcagtactttgggaggccaaggggagtgaatcgcttgaggtcaggagttcgagaccagcctggccaacatggtgaaaccccgtctctactaaaaatacaaaaaaattagctgggcgtggtggcaggcgcctgtaatcccagctacttgggaggctgaggcaggagaatcacttgaacccgggaggtggaggttgcagtgagctgaattgtgccactgcactccagcctgggcaacagagcaaaatgctgtctcaaaaacaaaaacaaaaacaaaatctgtttagaggggcccagggcttatatggcaaggagtgtcacagtgtcaggaacctgggctgcctttattcctttcatcctgtggctctgccgtacctggttttattttttttctttttgtttgctgttgttttttgagatggagttttgccctgtagcccaggctggagtgcaatggcgcaatcttggctcactgcaacctccgcctcctgggttcaagtgattttcctgcctcagcctccagagtagctgggactataggctcacgccaccacgcctggctgattttttgtacttttagtagagacggggtttcaccatgttggccaggctggtctccaactcctgacctcaggtgatccacctgcctcagcctcccaaagtactgggattacaggtgtgagccactgtgcctggcctctttttttcttttttttagacacagagtctggctctggggcccaggcttgagtgcagtggtgagacgggagaataagtcctagaggaagggaacctgaggacttcccagaactaaatcagatggagaggagagaggaggcatttcagctacgacaggaaatatcctcttcatttgcatagggcgttcaccaagtaagtgactttgtaacttcatcctcttcatttacatagggtgtacacccagtaaatagctttgtaacttcacttcagtaactcactttaagcctcttcatttacatagggtgcacaccaaataaccaatggaaacctctagagagtatttaaactccagaaaattctgtgacgggctcttgagccaacgtgctccggccgctcccactctgtgcagtcgactgtacttttgttttcaataaaactctgcttttgtttcttcattctttccttgatttgtttatacgttttgtccaattctttgttcaagacaccaagatcctggaaaccctccaacgctaacagtggcacgatcacaactcactgcagcctctcctgggctcaggtgatcctcccacctcagcctctcaagtagctgggactacaggcccacaccgccatgcccggctaattttcgtgctttttgtagagatggaggtctccctcggtttcccaggctggtctcgaacgcctgaccttgtgatccgcccgcctcagcctcccaaagtgttgggattacaggtgtgaaccaccgcgcccggcctggaccctccatttcttttttttttttgagacagagtctcgctctgttgccaaggctggagggcagtggctctatgttggcccactgcaagctccgcctccccggttcacgccattgtcctgcctcagcctcccgagtagctgggactacaggcgcctgccactacgcctggctaatttttttgtatttttagtagagactggatttcaccatgttagccaggatggtctccatctcctgacctcatgatccacccgcctcggcctcccaaagtgctgggattacaggcgtgagccaccgcgcccggcctagttttcttttttaagacggagtctcactctgtcgccgaggcttcactgcaacctccgtctcccaggttcaaaggtttctcctgcctcagcctcccaagtagctgggattataggcgcccaccaccatgcctggctaatttttgtatttttagtagagacggggttttgccatgttggccaggctggtcttgaactcctgacctcaggtgatccacccgcctcagcctcccaaagtgctgggattacaggcatgagccactgcactgggccacatgaatagttttcatttctgagatcacttcgtgttcaaaatggttgctgaaactcctgccattttatctgcattcccagaagtgagaagggagtagagtgtgcctttccctttaagaactctttatgaagtcaaacacactccttacattgaggccaaaaattagtcacatggccacacctatgtgtaagggaggctgggaaatgtcttaattccaggcagcaaatgccctgataaaatatcagcttctaatcccttggatctctgtgggaggtggaggtggggagtggaagtggaggaccgtgagcaatagctgatgtaatcactgagaagctgtgtgtccttgggcaaatcccttcacctctctgagctcctgcctgtctttgaaatgaggatgtagaaagatcatctccaaggacactccctgccttgacattttgagactctggcgcagggagcccagggtggtcaaagacaagaacagaagctgcttgggtttaaaagttgcctggccaggcacggtggctaacgcctgtaatcccagcactttaggaggccgaggcgagtgaatctccaggtcaggagttcgagagcagcctggccaacacggtgaaaccccgtctctactaaaaatacaaaaaaattacctgggcataatgacaggcacatgtaatcccagcaacttgggaggctgaggcaggagaatcgcttgaacccaggaggcggaggttgcagtgagccaagatcgcgccactgcactccagccctggcgacagagtgagactccgtctcaaaaaaaaaaaaaaaaaaatgttgcctgttctgggctgggcgcggtggctcatgcctataatcccaacaatttgggaggctgaggcaggcagatcacaaggtcaggagttcaagacgagcctggccaacatggagaaatcatgcctctgctaaaaatacaaaaaattagccgggcatggtggcaggcacctgtaatcccagctactcgggaggctgaggcaggagaatctcttgaacccaagagacagaggttgcagtgagcccagactgtgccactgcactccagactgggcaacagagcaagactccatctcaaaaaaaaaaagaatggctaaggcagagcaggtccgaaggcagctagttgcccttttgtttgtttgtttctaagatggagtctccctctgtttcccaggctggagtgcagtggcatgatcttggctccctgcaacctctgcctgctgtattcaagcgattctcctgcctcagcctccagagcagttgggattacaggcatgagccaccacgcctggctaactttttgtatttttagtagagacggggtttccccatgttggcctgtctggtctagaactcctgacctcagatgatctccctgccttggcctcccaaagtgctgggattacaggcctaagccaccatgcctggccaagcttgcccatttttatggttatttcttgattacatgctaaatagagggtgtattattcatgcctccccattttagaccatatagggtaacttcctgacgttgccatggcatttgtaaactttcatggtgctggtgggagtgtagcagtgaggacgccctgaggtcactcttaatcgccatcttggttttggtgggtgttggccagcttctttactgcagcctgtttcatcagcaaagtctttgtgacctgtatcttgtgccgacctcctatctcatcctgtgacttagaatgtcttaacctcctgggattgcagcccagtaggtctcagcttcattttactcagcccctgctcaagatggagttgctctggttcacacaactcaacactttgggagactgagatgggaggatcccttcagcacaggagttcaagaccagcctgggcaacatggcgatactccctctctgcaaaaaatatatgtaaattgccgggcacggtggcctgtaatcccagcactttgggaggccacggcgggaggatcacgaggtcaggagatcgagaccaccttggctaacacggtgaaaccccgtctctactaaaaatacaaaaactcagcccggcgtggtggcgggcacctgtagtcccagctactcgggaggctgaggcaggagaatagcgtgaacccaggaggcagagcttgtggtgagctgagatcgcgccactgcactccagcctgggtgacagagcgagactctgtctcaaaaaaaaaaaaaaaaaagatgtatatttacttatttacaaaaaccgggccaggctgggcgcggtggctcacacctgtaatcccagcactttgggaggccaagacgggtagatcacaaggtcagcagatcgagaccatcctggctaacacagtgaaaccccgtctctactaataatacaaaaaaaaaattcgccagatgtggtggcggacacctgtagtcccagctactcgggagactgaggcaagagaatggcatgaacccaggaggcagatctcgcagtgagccaagatcgcgccactgcgctccagcctgggcgacagagtgagactcagtctcaaaaacaaaagcaaacaaacaaaaaaactgggccagacgcggtggcttagcctgtaatcccagcactttgtgaggctgaggtgggcccacctgaggtcgggagttcgagaccagcctgcccaacatggtgaaaccccatatctactaaaaatacaaaaattagctgggcatggtggcaggtgcctgtaatcccagctattattgaggctgaggcaggagaatcacttgaaccgggaggtggaggttgcagtgagccgagatggcaccactgcactccatcctgggcaacagagactgtatctcagagaaaaaaaaaagggggggggcaggtgttttgtctcacgcctgtaatcccagcacttcgggaagccgaggcgggcagatcacaaggtcaggagttcgagaccagcctgggcgacatggtgaaacccccgtgtctactaaaaatacaaaaattagccaggcgtggtggcgcatgcctgtaatcccagctactcgggaggctgaggcaggagaatcatttgaacccaggaggcagaggttgcggtgagctgagattgcgccactgcactccagcctgggtgacagaacaagactctgtctcaaacaaacaaacaaaaaacgatctgtcctctggtgacacgggagcctggatgccttgctggagtggatagtctgtggctcgggggagactctctaggagcccccaggccaccctgttccttcctgcaaggctacttgctgccctgacccctctgaggggcaggcagggaggggagaggcactggggaaactgcagggggatgtggttgtgatccaggcctgtggagggagtgctggggaaggggagacttcagcaagggcagatgaagccttgttttttccttttttctttctttctttttttttttttttttttttgcgatggagtctcgccctgttgcccaggctggagtgcagtggcgtgatctcagttcactgcaagctctgcctcccgggttcatgcccttctcctgcctcagcttcccaagtagctgggactacaggcgcccaccatcacgcccggctaattttttgtatttttagtagagacggggtttcaccctgttagccaggatggtctcgatctcctgacctcgtgatccacctgcctcggcctcccaaagtgctgggattacaggcgtgagccactgctcccagccagatgaagcattgtgactctagggcatgtaaattccctggcagccaggccctgggagcacccctcccctcctgtgcccttgacacctacctcagtgaggcagccccagcagccgggcagtgggcggcagagaagggtgtcctgggacagaggttttcctagtctttcttcagaatggaggaagcccctggggtgcctggacttcctgtaggacccagggaagaaagatggccattctccctgtcgcgtgatgggggctccagctgttttacacaagaagacatataactttcatggttaagagcaggggttctgggcctgatggcttgggttcgaatcccggctcctatgcatgccagctgtgttacatacttctagacaaattacataacttctctgtgcctcactttcctccactgcaaaacgaggagtcctgagcaggtgagatcccctgacagctctcgggacagctggagtgctcagtgaaagctcttcgtgcaatcactgcggagggtgaccagggacatcgataggacgctggagggattaccctatgtcccccgacccgcccgactacaacagccttgcagataagccacgagcctgcctgctcctcctcgtgagttggagacaggagagggagcagagttcaggggcttgtttctttctttcttttttttttgagatggagtttcgattctgttgcccaggctggagtgcagtggcgcaatctcggctcactgcaacctctgcctcccaggttcaagtgattctcctgcctcagcctcctgagtagctgggattacaggcctgcgccaccatgcctggctaatttttgtatttttagtagagacaggggtttcaccatgtcgcccaggctggtctcgaactcctgaccttgtgatctgcccgccttggcctcccaaagtgctgggattacaggcgtgagccacggtgcctggccaggaccctccatttcttttttttttttttttttttttttttgagatggagtctcgctctgtcacccaggctggagtgcagtggtgcgatctcagctcactgcaagctccgcctcccgggttcatgccattctcctgcctcagcctctcgagtagctaggactacagtcgcctgccaccacacctggctaattttctgtatttttagtagagactgggtttcaccgtattagccaggatgttcttgatttcctgatcgcgtgatcctcccgcctcggcctcccaaagtgctgggattacaggtgtgagccactgcgcccggctggaccctccatttctaataagctcctgggagagtcctccctggtgctctgagggtgactgaccggcaaggcacttctggggcccctaagccctccaacctcagctgctgtggagagctgacccccaggggagtacgtcagggtgctgggtggggcaccagtttcaaggatgcccaacacagccctccccttggggctgcaaggccctgggaccagcggcccagccctgtccccaggcaggtcctcagacctaggaccacaggggggtctggggcccaggccaagggcaaacctgctgggatctgagcccctcttggtggcttcctggtgtgtgcacatccttccccaggcaggagaggaagcagggccagctccttctcctcccagggcaagacctgaagtctctgtttgtgtgtctgtcagacttgctgtgagggccacagtgtctccactgaggccttatccagcctccaggaggtcccatttttcagggaaagggcctgctgctgaaggctgtcactcatctgacttcaaatcccagctctgccacttccaggctgtgtgactccaggcaagttgcttaacctctctgtgcccactacttctgtaaatggggatatcatgggattctcgtgagctgtgaatagcatctgttgatgtgtttgtttctgtgcattcagactttccctctttcctcaggcacttgccgggcagccttctgtgccacatccctgaccctgccccagggcacaccagcttcagtgacagggatggctggtgaacaggaggcccaggcctgctgctctggccgatgtaaatccaaggagctgtgatgacgcgggagaggggcggtttgggaaaaaatgtgtgaaggatgcccccgtgggagcaggagccccactggcaggggcaggccgggggtaactcagccacagggaaggggcccagccggggctggagggagggccacctgcagaaatgagctgtgggggggcgagaagggcaggcagctggggctgaggaagaccagcccccaagacacccatggagaaactgaggcagaatctgtacttggagccagccaccgctctccactggcccacactgctgtgatccttcccacgctgcgcggctggctggaacccaaaccccccacagcgggcctggccttcagagctggttccagatgtttaaatacccagccttcacctcccgtcacagacacttccactggaaggtgttggtgccacatccccagtgctgccaggctaatatggggtgggggccttgcagccccaaggggagggctgtgttgagcgttctggacactggtgccccacccagcacccagcaggggcactctgcgctgtgctgcccctccccagctgcctgggccaccagttcaggagagctcacccctttgcaacctttcccaactcaatgccacgccaggaagtcaggagggggatgaccctgccacactctgccccccagctcccttcccaccatgccccgggaccaagacaggagggccagctgggcccagggcacttcgccagtatcatcgggtcctcaccacagccctcaagggggtgttcctgttccacacacagaagactgaggcccagggatgggactgggtcgtgtgaaacgccaggccatgcccggccccgcagagtcctgcgtagctgcccggccggcccagggctcagatcccctcctccaggcctggccccagctgctattggggcccactgaggcctactggatcctaactggatgcaattaggacatcacctgatgcccctgtcagggtggctcctcccaaccgctagaggactcaggccaaaggcatttggggtgcagcccccaccctggccctggtgggccggagtcatgctctatgtgccccccagctgtccaagcaggggtgtacagagactctggggtggggtgagggtgagagcctgagaaggctgttgcggaggacacaccggaaactgtcaccaggccctgccctcagccgacccgggccagggccaggagggcctcctgggggccgccatctttctgttctgggaaggccaggctgggggtgagctccatggggctcctgtgtcctcatccattggtgggatgcggctccctcccggggacctctcagggcactgataagagccaccaggactaggttcagcccacagcaggtgggatgcacccgccccttggcgggccgggggtggagaccgggagtttctggagaaggcctttcagattctgaaggcaggcactccatgccccatccctggagcgcgagtgacaagtgtctttgtcacagaaggacagaaaggccctacgtggcccctgagcagctctggggaacattcttggtccgggttcctgtctgggggttctggagtctaggattccaggatctgggttttgaggtcttgggttgtagggtctgcggtttgaagcccctcttgtaacccaggacagaggtgaaagcagtggggtggactgggcagcccccaaagttcaatggacctaaagtgctggtgctcagccctgcccaggcagctggcaggtggtccagaaacccctcgttctatggagactgaggcccaagtctttggaggtggtcaggggtctgtcccagagcacctttgggcgaaaggtagggggaagaccacccaagacgaccctccccaacaccagcaagggagcccagcatctcctctgaggccactgccctgtgggtccagcctctctgggctgggtgtgtggaggccgctcctatggcggtgtgggcggtgcagctcattcccccggggctcccagcctcccacccccatccggcctcctcctccagagcctggggactggtggatgcctgccaagaacgcccacagcctgccaggatgcgcaggaagcacacacacgcctaatcccacccccattgtcatagatccctcttgattctgggcctgtctttctgggggaaactgaggcccagagggattgagggcccccaaggtccccgagtctccaggtgtaccttggaggctgtgctttagtggggcctcccccggccttctttgcagtcctgagtgtgtgaaggggaggaatcgggggctgccaggccaggagccaaggccgggggtggggagcagctggcaggtgtcccggcaggaggcccggctaggggagaccagaactcctctgctcctccctcccaacggcttcccaccccactctacagcaggccgctggcaggcccggaagggcttgggagccggagggtgcttgccggggctcctgaaggcctgaggagctcctgagggactggaggcttcgggcctggaaggctggaaggcactggccctgcagcttggttcccggggctccacgtgtctgaatgcaaaacaaaggcggctcacaatgagaaggcgggtgctggggatctgcccccgtcgtgcatgtgtcaccacacggtgtcgaagcggacacctgcctccgggatgagcgcattgggcaacactgcatgctttgcattgggaacatgtttgtgtgtgtgcgttgggggtgtgtgtgcggtggggggctatgggctgggatgtcccttgaggtgatcagctctctacgttccgcacacacaaacacacagtgtgactgagacacacatgtgagtattgagatctccagggctgacttcctgccggaagcatgccctggcccccgtcaccttgtgtgaaattcctccacctgagcaccttcccggtagagccacgcgttgcctgtgatggaggggccatgactaacccaggcactaggcctggaggctgggctggctgcgctgtacagttgcaaggacctgccagacagctctgtggacagagcctccgtcggggtttcaccacgttggccaggctggtcttgaactcctgacctcaggtggtctgcctgcctcggcctcccaaggtgctgggattatacgcatgagccacagtctcgctctgtcacccaggctggagtgtagtggcacaatcacagctcactgtagcctcgacctcctcagctcaagcgatcctcccacctcagcctcccaagtagctgagactactacaggtgtgcaccaccacacccggctaattttttaagtttttgtagagatggggtttcgccatgttatccaggctggtctttttttttttgttttgttttgagacggagtctagcactgtcacccaggctggagtgcagtggcgtgatctcaagttgctgcaacctccacctcctgggttccagcgattctcctgcctcagcctcccgagtagctgggagtccaggcacctgccaccacgaccagctaatttttttatttttagtagagacggggtttcactgtgttagccaggatggtctcgaactcctgaccttgtgatccgcccacctcggcctcccatttacagtagactgttttctactgtaaaaggctttttcaatcaactttggtattaggtgtctatttactactgcatagtcaattacctcaaagcttagcaactgaaaaccaaacgccatctcgcagcataggtgggttagaaattcagaagtggcccagcccatggctctggcccagggtctccagcaggctgcagaggggacagcagtgacttggagggatttcttccaagctcacccacagggggaagccttcagctcctggccaccttcgcctctccggcctgggacagctgactctccccagggcaagagagcaagaagggggggccaccactacccaaaacaaaagttggtctttttttggccaggtgcggtgactcacgcctataatcccagcgattctcctgcctcagccccccgagtagctgggagtccaggcgcctgccaccacgcccaggctgatttttgtatttttagtagagacatggtttcaccatgttggccaggctggtctcaatctcctgaccttgtgatctgcccatctgagcctcccaaagttctgggattacaggcgtgagccactgtgctgggccatgtgggtcgtattctattcctaagtcacccagtcctacccacactcagggagtacacaagggaacagacagcaggaggcagggattgctgggggccttcctggaggctgagtatgatgagcgcccggtgaggagtcctacaaagttggtaaggggtccgctcttggaatggatcgtagtcatactcgaacacttactctgtccaggcactgctccaagaactttatgttgagccctcactaccaccttgggctcggcatgtgagcctcactttacggaataataaagagaagagaagtggccaggcacagtggttcacgcctgtaatcccagcactttgggaggccgaggtgggtggatcgtgaggtcggagttcgagactagcctggccaacaaggtgaatccccgtctctactaaaaatgcaaaaattagtggggcgtggtggcgggcgcctataatcccagctactcaggaggcagaggcagaaaactgcctgaatccaagagatggagggtgcagtgagccaagatcgtgccactgcactccagcctgggtgacagagcgagactctatctcaaaaataaataaataaataaaataaaaaaaagagagagagaggaaaagtgtcttgttctcaaatccctcagcccataagagctctggagctggctgggattccagtctacatgggtttgtacccaaggaggaagctgggctgggcaggctgtgcctcagagcctgcaagatatggcactatgtcccccatgggagctgatattggatcagttcaggaaaaggtgacatcagaagaggctctgtgggtgccctaagccaggggtggagggcagagggttggggagaggagctcacccccaggagagggtttggaggttagacagaagagggctaaggtcagggaccaagggctctgtgtctaaagatggcccagggaagagggagtcagctagaatgtgggggaggccaggaagggaggctgcagtggtgtggactcctctgcaggagcagcctggccatgtgatggcacaggagcagggcagcgtggggtcaaggcccacagggggcaagctttccgttccggtggctgggtgggagcatggccacattctttaccctctcattgggccagtgctgccccagaccctgtctgggctgatgccccagatgtggcctgccagctcaccagccctgaggccacgtgtcccaggtgccccacccggggcggtgcccccccatccattgccccagctagtccagcctatgtgcccagcaccctgccctctagcctctgccctcagcccctgggagccatcactcttcatgaagcaacctgacccttaggccaggctgtcacactgctgggcacctccctctccagggagcccaacagacgtcctaacctttcccagacctttttattttatttttttaaatatatatatgcacgtattagagatggggtcttgctatgttggccaggttggtcttgaactcctgtcctctcacatcggcctcccaaagtgctgggattacaggcatgagccacggcatttggcctctcatacctttgagagtgcagatgaggaatttttgcagagggccacaagaatcctgcctactccgccctcccccgcccccaccaccacccaacaaatgcagatatttggtgtctccccagaatcaatgtccagcactcaccaggggccacaagccctggccaaggcctgtctgcctgtcccagtgtctgtctctgtccctcccgaccagcctcggaatctctccagcaaacactggaccactctgcccggctcctcccagctgcatgtatccacccagcccccagatgccagcaaaggctccactgaccaccccccagaggggcgggtgtgccgtccccaccacctagtccagcctagctggccacaggcctccacccgcatttccagcctttgtccgagtcattctcctgcctaacctgtccctctcccttctccaaacgtccagatctttcccatcctttagggctctgctcaaagccggatagctgagtctgagaaagtgacccaacctctttgagccttagtttcccccctcccttgccagggaactgggaggagggaagagggtgcggccgtggggagcctggctccccgcatccgcccagcccgcggggctccccatcccggccagtggctccctaagccttgccaggtggtgacggctccttgggcggcccattcccgccccgcaaaaccagctaagggcccctgaaacgctgcccggaacgccccgcgggagaacatctgcgccaggggccgggggccgggggccgcggcgggcgaaatccgagaggcccgggctcctcctgctgcgcggccggggaggggggcgcctgccgggtcggggctggaggacctgcgcgcggccccgggaggccccgcctcgccttccagtctgtgaaatggggcgacggcctgggcgtggcggcgagttcttgtccgctgccggcgggcgcggtcgtcgaggacacagctaggggaggcgcagaaacacccggaggcggcaccgccgtctcctccccgggatcccacaccccgcaggttcaggaggaaggcgcggcccgaggcctccggggcggggtgtccccgagacgggaacccgaacccgacggcctccgttccgcctgcgccccttcaaggctcccggacgggcctcagtggcttccccgcccctccccaccgcgtcccggctccccgggcggggggtggggggggtcgcgtgcggacggttccccaccccgcgcgtgcgcacctctcctcccccaggagattaagtggggactctgaaccctgtctccagccctgatggggaggagtaatccgattgctttccaaacccggcctcgccttgcaaacttgtccacccccaacccacccggacggccgggccgccgcctcctctgggcctcgtctccccttcaagcccccggccttgtggggaagggggaatccttgacgcattttacagacggcacatagggtcggggcagtgctttaaccggagaccaggagcctgactcttccagggctctgtgagacagcctggtgcctggcgggggtgacacagccccactgtctgccccgcgtttacagccaggaaccacacctgagccatttccaagggtgacatgtgtcacagaactgtggggaaggggctatccagagattcccagtaggagacacggggagacctgcagggtgagtttggacgggactagagagggggcagggctgggggaagaaagtgcccccagcggttggccctgagagaggattccagggctcccttgaaagaacagcggggtgggggtggggagcagaaaggaggcctgcgggccacatgcagcctctggatctcagcccagcagcccgaggagccacagctgggtgcagagtggctcattcgtattttactagatccctcgggcctctgtgccttcccagggctctgcaagccggggaagaaaagaatcgttgcttcatcctgcaactcccagacggtgcttcccgaccctggtgcgggtggtgaggagggggagggaggtggttgtgaggcctgctttgcagttgtttgtggaatacagtaagattcttggctgggatgagccgaacaggacgaagaaccgaattctgccggggccgcttaaggaagactgcctaggcgaggtggcccaggctggggatgagccagtggaggaggaagtctcgagagaggggacagcagtgagcccagcaccctctccatgggagtctgagtgtaaggcatcccgacctgtctgccagcgtctctctctgctgggggctgctaaggtgcagataggaagcggtcgggggcctctgtgtatgggtggaggaggcggatggtggggggcaggcaggcgacggggcagggaagaccctatgaaaactaggacctgtcctatggacaggcttcaccggcggacagtgggggaatctggttaaactctgagtctaaacctcacgctggccgggcacggtggctcatgcctgtaaatcccagcactttgggaggccgaggcaggcagatcacaaggtcaggagtttgagaccagcctggccaatatggtgaaaccccgtctctactaaaaacacaaaaattagccgggcgtggtggcaggcgcctgtagtcccagctacttgggaggctgaggcagcagaattgcttgaacctgagaggcagaggttgcagtgagctgagatcgtgcactccagcctgggtgacagagtgagactctgtctcaaaaaaaaaaaaaaaaagaaagaaattaccagggtagggcatggtggctcacgcctgtaatcccagcactttgggagacggaggcaggtggatcgcttgagtccaggagttcaagagcagcctgggcaatgtggtgaaacctcatctttattaaaaatacaaaaattagccaggtgtggtggtgggcgcctgtaatcccaggtacttgggaggctgaggcaggagaatcgctggaacctggggtgcggaggtttgcagtgagctgaaattccactactgcactccagcctgggcgacagagcaggactccatcttgaaaaaaaaaatctctacaaaaaaatacaaaaactagccgggcatggtggtgtgcacctgtagtcccagctggctcgggaggttgaggtgggaggattgcttgagcctgggaggcggaggtgccagtgagccgagatcacaccactgcactccagcctgggcaagagagcaagactggaaagaaaaaaagagagaaagaaagaaagagagagacagagagagagagaaaggaaggaagaaagggagggacggagggacggagggagggagggagagaatgaaggaaggaaggaaggaaaaaggaaggaaagaaagaggaaggaagggagggaggaaggaaggagaaaaataaataactgaacacatatttatcttacagtttctccacatcaggagtctgtgcatgattaagctggtcatttgcttagggtctcacaaagctgcaatcaagggtcccactgggatttcagttgaatttggctggggaaggatacgcttctgagccaccgaagttgctggtggagttcagttatttgctgctgtaggactgagggcttcagttttgttttgtttgtttgttttttgccaactattggatttagaggctgtccttagatcctagaggcaagctgttatctccacatggcagttccttgccatgggggcctttcagtgtaacagcatggcagcttccttctttttctttttttgagacagagtctcactctgtcacccaggctggagtgcagtggagagatctcggctcaccgaaacctctgccttctgggttcaagtgattctcctgcctcagcctcccaagtagctgggattacaggcatgtgccaccatgcctggctagttttgtatctttagtagagacggggtttctccatgatggtcaggctggtctcgaactcccgacctccggcgacccacccaccttggcctcccaaagtgctgggattacaggtgtgagccaccatgcccagcagcagcttccttcttctaagccagtgagaggggaagagactcaagcgagataggcacaacagtcttatgtgatgtaatcccatatattccatcacctttgtcctgttggttccagcgagtcacaggtcattcccacactcaacaggagggactacaaaacggtgcaaacaccgagggcagggatctttgggagctacttttttttttttttttttttttgagacagagtctcgctctgtcgcccaggctggagtgcagtggtgtgatcttggctcactgcaacctctgcctcccgggttcaagcgattctcctgcctcagtctctcgcatagctgagactacaggcacatgccaccacgcccagctaaattttttttgtattttaatagagacagatttcaccgtgttgcccaggctgacctcgaactcctgagctcaggcaatccacccttctcagcctccgaaagtgctaagatgataggcgtaagccactgcctccagcctgggagttattttggaaggaccctaactacactaagcaactaaaaagaaaggcaattattaacttcatgaaaaactgaaagttaaaccagaaaggaaacttaaccacagtgcattagttggctcagtagcaaacaatgtttatataatcattataatgaaactgaatattgatttgatccgaaattgctctatattgataatgagaggtgacacagggagagtatggggaggggggtgttgcacggaagagtgtaaaaaatgtgaaactcatcttctgtaagggaaagccagtagataatggctgggttgttaaatcaagtaacaacagcacaagaatgttatttataaacatggagataaaatccagaaaaagaagccaaaaaagttgaatgtggctgtctctggggaggattaagagtgggataggtggggaggggctgctgcttttcactatgtctatttgccttttaaaattctatgcatatcatgtgcctatactttattgcattacttggataaaaatatacagtaattaatagagaaaggggtaggggaggagaagcatccttgaagagtgaacagtgaagttccctgggggacaggctcccatttagaggcagagatgggggaggaacaatatcccctgggaaccctcaggggctcatacaccagaaattacagtaaccagagcttgcaccaggagaatatagtaactgcctggggcctgggggaggtgggcgttcctggggctggggggatttgagaggatagtggtgggggtgagcttggatcctccttggggtggagaaggagcctcgggccccgagtgggtttcccccaccctaggagtctcccatctccatagacatttcttggggagactctgaaggctctgaccaggttttcttttgttgttagaaagggggtctcgctatgttgcccaggctggagtacaatggctattcacaggcatgatcatagctcactgcagccacgaaatcctgggctcatgatcctcccacttcagtctctcaagtagctggaactacaggcatgcaccactgcagcacctggcttttttttttttttttttttttttggcagacggagtctcactctgtcgcccaggctggagtgcaatggcacgatctcagctcactgcaacctccacctcccgggttcaagcgattcttctgcctcaacctcccgagtagctgggactgtaggtgcccgccaccatgcccggctattttgttttatttattttttttaacagtctcactctgtcacccaggctggagtgcagtggcaggatctcggctcactgcaacctccacctcctgggttcaagtgattctcctgcctcagcctcctgagtagctgggattacaggtgcctgccaccatgcccagctaattttttttgtatttttagtagaagcggggtttcaccatgttggccaggctggtctcaaactcctgacctcaggtgatccacccgcctcagcctcccagagtgctgggattacaggtgtgagccaccgtgcctggcctttttttttttttttttttgagacaggatctcactcgttcactcagattggagtgcagtggtgtgatctcagctcactgcaacctctgcctcccaggctcaggtgattctcccgcctcagcctcccaagtagctgggaccacaggcatgcaccaccatgcctggctaactttttgtattcttagcagagatggcgttttgccctgttggccaggctggtttcaaactcttgagctcagacaatccaccctctttggcttcccaaagggctggtattacaggcatcagccactgcgccccagcctatctctgtcactttctccctgccttcctctctcctccacagaatgatctctcgcagcacccaagtctgcaccctgcttcactcactcagcaatctgtccaggagctccttcaatgtcaagacatccagaaagatctgtcttcctccttttccaggcccctgtgcaggaaccccctgcacctggtcccccgtgatgggtgctcaggttggtgcagaactttgcttttattaattatgcgacagatggaacccctcagcacatcctacgaggctttcttttgccctgggatgccctacgaacctgccctgggatgccaggtccatctaggtacactcgtcataggccaggtgtcccaggccccagcagctgtgtggacagctgtgaggaaaggagagtaaggaggaagaatgctggtgactttgggtcaggaagggatttctgggctgggtgcagtgacccacacctgtaatcccagcactttggaaggctgaggcggggaatcacttgagcctaggagttcaagaccagcctggggaacatagcgagaccctgtctcaaaaaaagaagaagaagaaagggacttctgggggttccttggttgctggcactccccaagggcacagggctatctctggggctgccactgtgggcctgggcactggtgatggggggtggggagatggctgagagtccctgtctggagcacagtccctggctggaaggtgattctggctgtcagaggcatttgaaccagagcaactccattttgaataggggctgtgtaaagtgaggctgagacctagatgggctgcactcccagagggttaaggcattctaagacaggatgagataggaggtcggcacaagatacaggtcataaagaccttgctgataaaacaacttggagtaaacaagccggccaacacccaccaaaaccaagatggtgacaagagtgacctctggtcatcctcactgctacactcccaccagcaccataacaatttacaaatgccatggcaacgttaggaagttaccctatatggtctgaaaaggggaggcatgaataatccaccccttgttttgcatataatcaagaaataacctttgggtgtggtggctcatgcctataatcccagcattttgggaggctgaggtgggtggatcacttgaggccaggagttagagaccagcctggccaacatggtgaaaccccgtctctactaaaaatataaaaattagccgggtttgatcccagctacttgggaggctgagtcaggagaatcgcttgaacccaggaggtggaggttgtggtgagccgagaccgtgccattgcactccagcctgggcaacaagagtgaaactctgtctcaaagaaaaaaaaaaagggcaaccagcagccctcagggctgctctgtatgtgaactagcaattcttttttcctaatcaacttgctttcagtttactctatggactcgcctggaattctttcttgtgtgagatccaagaatcctccctctcttggggtctggatgaggacccctttctggtaatatggcctcttacccccttggtataccttaaggtggccttgggcaacttacattacatctctgggcctcagtttcctcctctaaaaaatggggataacaaaagcccctctcctaggagaagaggcagggaacagctggacagggcagagagcctatcttgggatcccggggaggggctatgaaggaaaggcttcaggaattgagtgggacagggtatgggtcagaattctggtctgagctgcctgccccatgactccaggccctcccgtggcagggcccaggcacctggcctccaagcctcagtttcctcgactcagcaatgggcatggcagccccaaccttggagtgacatattgtctaataaccctgactcactccccacctcccacgcccaggggcccctgcagtcctgagatgggccaagtcaagccacacctctcttccggctggagcagcctgaccaagtcccacttgctgttctgccagggagcctgattttggcactggtgtatttccagaaccaaggtgggtgcccggtctgaggccctagcgggtgtctgggtcccttcctggaggccccttgcctccctcagccctggcttttgggacttagcaggggaggaagttttttgttttgttttgttttgagacgaagtctcactgtcaccaaggctggagtgcagtggcacaatctcggctcactgcaacctccctctcctgggttcaagcgattctcccgcctcagcgttgcgagttgctgggactacaggtacgtgtcactacacaggctaatttttgtattttttagtagagatgaggtttcactgtgttagccaggctgaactcctgacctcatgatccgcccgcctcggcctcccaaagtgctgggattaccggcatgagccaccgcgcccggcctatgggaggaagttctgacatggatggcaggggtggggagggcagctgaggactctggagcagaggctggggccccactctggctttccctggccctaaaggaagggtggggtctgagagtgtggaggcctgagagcaggggcagcacagacacccactctgagaccacttggttgtcccagccaccgggttccaggtgtctggggccaggtggggttttctctccaagcccagagtgacctccccactcccagccttgcccagagcaagtcttgctgagttctaaggtgaactcccacttgttccagaccagggacacagggtcctgcaggcctcccggagcaagcactcttgagagggcttctccacgtggccacaggacagactgtgcttcatccagcactgtacgctcaaacacacacacctgaaacaaaggctccacgaacaggcctgcccttacagcacaccatgctcttgtttagtcttccttatgttttttgttttcgttttgagacggagtcttgccctattgcccaggctggagtgcagtggtgcaatcttggctcactgcaacctctgccttccaggttcaagcgattctcctgcctcagcctcctgagtagctgggattacaggcacacagcaccatgcccggctagtttttctatttttagtagagaaagggtttcaccatgttggtcaggctagtctcgaactcctgacctcgtgatctgcccgcttcggcctcccaaagtgttgggattacaggcatgagccaccacacccggctgtcttccttatttttttaaatgccagctgttttatgcacaattgtcccaaactagaaacaacccaattatccatcaactggtaaaggaataaactaatgtgttatctttgtttgtttatttaattttgatacagggtcccactctgtcgcccaggctggagtacagtggagagatcacaggtaactacagcctaaacctcttgggctcaagtgatcttcccacctcgggcacacctggctaatttttttttttaattgaatgtggtatattatttaaaaggaatgctggccaggtgtggtggctcatgcctgtctgtaatcccaacactttgggaggccaaggtgggtggatcacctgaggtcaggagttcaatatcagcctggccaacatggtgaaaccctgtctctactaaaaatacaaaagttagccatgcgtggtggcgcacgcctgtaatctcagctacttgggaggctgaaacacgagaattgcttgaaactgggaggcagaggttgcaaagtaaaccaagtttatgccactgtgttccagcctgggcgacagagcgagactgtctcaaaaaaaaaaagaaaaaaaaaactataatggtaaattttgctatgtatatttttatcagtgtttaaaaaaaaacataacaaactctcccttggctctgccatgctccttatagggcaggctactgtaaaatgaaactacgggccaggcacggtggctcatgcctgtaatcccagcactttgggaggccaagatgggtggatcacctgaggtcgggagttcgagaccagcctgaccaatatggagaaacccccgtctctactaaaaatacaaatttagtcgggtgtggtggcacatgcctgtaatcccagctacttgggaggctgaggcaggagaatcacttgaacccaggagtcggaggttgcagttgagccgagatcatagcatgccattgcactccagcctgggggacaagagcgaaactctgtctcacaaaaaaaaaaaaaaaaaaaaaaaaaggaagaaaggaaggaaggaaagagagagaaagaaactacagggactcttgttaaaaaattattaagaatttcaagatggcaacagcagcatattaaaaccaagtgtggtctcttctaggctcaggaccctatgggattgcacaggtcgcagcccaagcgcagtacttgcgcacaggtcccagccccttccctctctgggacttgtcttctggcccctcactcctgcgatgagcttttctttcagctggtgaaaggccgcagacttcgaacctctgggcctttgtccaggacgttccctcagcgctcagtgcccttcctggtggcctcctacatcttcagatcccggctgagctctgcttaaatccgggaccgggtagtcactggggcagccacttggctggggcgaggccacctcgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagcccctcgggcttatagccgggttgttctttccttaaatctcctccctctgccaaaataaaaaaccccacagggcaaggcgcggtggctcacgcctgtaatcccagcactttgggaggccgaggcaggtggatcacctgaggtcaggagttcgagaccagccttaccaatttggtgaaaccccgtctctactaaaaatacaaaaattagctggacgtggtggccggcgcctgtaatcccagctactcggtaggctgagataggagaattgcttggacccgggaggctaaggtcagtgagccgagatcgtgccactgcactccagcctgggcgacagagggagactccgtctcaaaaaaaagaaaaaaaaaaaaaaacccacagcgtcccggaggggcctgaggagttgtgaggggccgcctccgcctccagcatctggcatctggaggaggaggctgaggctgaggtgagggtgagggtgggtgacccgcacctgtccaggcccaggttgcctgctcccagcttgggctgggcagtggggcagggccatgatcccgccagtgctgtggttagccctacacctggcctggctgaggacagcgaacctggcaggtccaacctgggccctcccagcctaggatctccaaggcctcgtctcagtcaccatcagctgctctagggtgcagtggggcccaaggaggattgggcctgatctctgccccccagagcccatggacccaggactgggcccaccaggcgtgtcgcaggcatagggtcagtggcttctcaacagctgctggccccggcgcccctcaccaccccacctccactggtcagaaccaccacactgccagagactgggtttccctgcagttctgaccagtggggatggggtgaggtggaagggacattgcttggccgggcacggtggctcacacctgtaatcccagcactttgggaggccaaggcaggtggatcacttgaggtcaggggctcaagatcagcctggccaacatggtaaaaccccatctctactaaaaatgcaaaaattagccaggcatggtggtttgcacctgtaatcccagctactcgggaggctgaggcaggagaattgctcaaacccaggaggcggaggttgcaatgagccaagattatgccattgcactctagcctgggtgacagagcgagactgtctccaaaacaacaacaaaaaaggcagaggagtggggagtctggatggctccgctggtccagcccacccctcaggggacagactggttgacttgacgggttcactgagagtgctaggaccggccccaggtgtagtgccctccctgcggtgtcctgaggtaaagcctgccactctgagcctgctttctcttgccaggagacaggaccttgtccgctgcagctgggacatggtgtggataaaacctgtcagacagtgggcgtcctcctgccctgaagcctcccctctccctggtagccttcaggccccccagattctggtctctcggcctgctgtctcctttttccttggtaccttggcacctgaactcgcttggagtgtctaaggagctgcctgtgacaccatggggacctctattggtcccagcatcccctgcccagccgtggggggcatcggtgtcagccctgccaaggatcagtcagccaatcaacaaaccgcagggatcacccagctcatggatgtgggtgccgggaggcagggagggccacacaatgaagagatgtgtgtggtcctccatgctcagagatcctcatgcccctctcccagggatgggagttcccctccccatcaggggtagccctagggcccccagccccactctcactagggccagcctctctgtgaacccctggactcacatcacgtgtgcggggcccagctttgaggtggaagaccaaaccttggcattgcttctgtggaagctcaggaaatgcccacgatatggcctgaccaccccattcacacgaggatggagggagcaccctggtcacctgggggttgtggttagagtgccctccagccgagcctgcagcccagaccgagctagactggaaggggtagaagggcattcaggtagggacacagcctgggcaaaggggccctgacctttggcagctgcgggaagatgagcccacctgaaagggaggctgcattgagtgcagtcaggacctgggctgtagggctcagcctctagacagcaggagcacagaagggcgtggcggggtctcctgcccggccataataaacaggcccaagacttgttcacacaggtcccaggaatatgctgggtttgccttacgtataatttgtgattcatacctctcagtcttccagaaagatgcagtctacagaaattcagaaacaatcaatttgtaagaatagacatagataattttgaacaaccaagattagtgggagataggcatttacccaattctaggacattaatgattagtaatcaggcatcagacatagctgtggtcagccatggtggctcacacctgaaataccagcactttgggaggccaagacagaaggctcccttgagttcaggagttctagaccagcctgggcaacagagtgaaaccctgtgtctacaaaaaataaaaataaaataaaataaacaaattagcctgtggtcccagctacctaccagggagcctgaggtggaaggatcgcttacgcccgaggtcgaggctgcagtgagcagtgattgcaccactgcactccagcctgagtgacagagtgaggccccgtattaaaaaaaaaccccaaaaacttagctatgagtttcctggcagtcgaggcatgaagggaatgagaatggactatggaacttcactgtgtgatcacagcggagtatatcaggcagccaggaggccctcacttatatacccaagcctcaggcagcaggcatgttctgtggcggcctctggaaacaggccatcagggccgggaggacagagatggctgtgagctgggcctgcaccctcagggccctgcctgttgagtggctccagggtgtcttgccctctctgggcctctgggccaaggctaacccaactctctgggtcacaggggctcaagacctcagtggcaggtcatgaggaaggctgccctgccagcctcaccctggctccccacccactgcctgcttctttttttttttttttttttttgagatggagtctcgctctgtcacccagtctggagtgcagtggcgcgatctcggctcactgcaagctccgcctcctgggttcacgccattctcctgcctcagcctcctgagtagctgggactacaggcgcccgccaccacgctgggctagtttttttttttttgtatttttagtagagacggggtttcagcatgttagccaggatagtctcgatctcctgacctcgtgatccgcccgcctcggcctcccaaagtgctgggattacaggcgtgagccaccgtacccagccctgcctgcttcttaagtggcccaggaggacagggagtgagcttgtctctccccactgcagggtcctgagggctggggactgtgctgacactggtctctcccctgcctaggcatatcctgttcctagtgcttggaacacccttcccaccctcacatgcctggcaaattgttcttcacctctaggttcacatgtcgcctccttcagctttaaattcctacacgaggccaggcgcagtggctcacgcctgtaatcccagcactttgggaggctgagacgagcagatcacgaggtcaagagatcgagaccatcctggccaacatggtgaaaccccctctctactaaaaacacaaaaagttagctgagcatggtgtcatgtgcctgtaatccagctactcaggaggctgaggcaggagaatcgcttgaacccgggaggtggaggttgcagtgagccaagattgagccactgcacttcagcctgagagacagagtgagactccgtctcaaaaataaaataaaataaattcctacacgaaggctggggctggctccgagtgagcgggcctggggtatttgtgggataatgtaacttgggagtgtctaagtaggaaaaaactttaggttcttcagtcccattgtgcatggggaaacagaggccctgtgctggtaagtaatggggcagaagccagggtggctgcctcagttggagggaaagcggcaccaagattcacaggacagctctggggtcctggtcgcagtccctgccgtgccgccttctcactcagtgaccctgagcaagctgcttgccacgagatgtcggctccgtggcagtggatagcttcagccgtgggaagtccttggcaatcccctggctcgcggctggtgctcagctgggttcgctctgactagcactgcaccttggtcaccacctcgactgccacacaccctcccccagtggagacagagccaggggtctctcagcttccccaaccctggctccccattgtccagcctcagggatttggagactgggacaaactagccatgcgggggaaaggtgttccagaggagggaacacagtgagccaacaagaggatgggatggggcagggcctgttccaggaacaggctggggtcactctcccttctccagagtccaaggcacatgggtggtgggagaagagataggagaggctggcgaaaaccagcccgcaaggccctaaatgcctgactaagaagcttcagtctttcactgaagttttggagctaggttgggtgcagtcagatagcttgggggctgggccggagcatctggtggagagtgagacaccggtgtgagctgcagccctcgctgtgggtcccagcacccaggactgcacccagcccaggactgcagcaagcaggcacaggatgcgtggctgactgaggcctgtactccgactggagtcacctaggagattggctgagatgacctccagaagggccttgccccaggccggaccccaaggggaagctggctctatgtctttggacgagttaggaactcattgggggtggctgcggttttatttggggattcagctgtgccctgcacaccagctgctgagcaatgtctccaggaagccacagctgccctctgggaggcagggggccaggtgcagtagaggagatgccccagcggctcatgcaggagctcactcagacgccagaaccccagccaaggaggcaccccagacccaggcccaccagggccagtgtccccactccacgacaggggcactgcagccggggtggacacccagccttgctgctcactagtcacgtggtctgggcaagtctcttcctcttccctgagtgaggtgaggcaggatgggctaggatatgtggtggtaacaaacaactccagtctctttttttataatttcctacagacttttttttgttcttgttgaggcagagtatcgctcaattgctaaggctggagcacagtggtgctatctcagctcactgcaacccccactccccaggttcaagttattctcttgcctcagcctcccaagtagctgggattacaggcgtgcaccaccaaacctggctaatttttgtacttttagtagagatggggtttcatcatattggccaggctggtctcgaactcctgacctcaagtgatccacccgcctcggcctcccaaagtgttgggattacaggcatgagccaccgcacccggccaacctgtagattttttgagataaaacagctttattgagatctaattcacatatcacacaattcattttaaagcgtgcagctctctgtggtggatggtatattcgcagagttgtgcaaccatcaccacaatcaattttagaacattttcgaggccgggcgcggtggctcacgcctgtaatcctagcactttgggaggccaaggcgggcagatcacctgaagtcaggagtttgagaccagcctgggcaacatggtgaaacccccctctactaaaaatacaaaaattagctgggcatggtggagggcgcctgtaatcccagctactctggaggctgaggcaggagaatcgcttgaacccaggaggcagaggttgcagtgagccgagattgcaccacggcactccagcctgggcgacagagtgagactctgtctcagaaaaaaaaaaaaaaaaaaaagaacattttaatcaccctccaaacacaccatgtacccattagtaaccactctccatttacctgctctgcccagcccctggcaaccactcacacactttccatctctatgggtttgcgtgttctggacatttcatataaatgaaaccatatgacgtcgccttttgtgactgacttctttcacttagcaaaactttttaaaaatagcttttattggctgggtgcagttgtttgtgcctgtaatcccagcactttgggaggccgaggcgggccgatcacgaggtcaggagatccagaacatcctggccaacatgatgaaaccccgtctctactaaaagtacaaaaattatccgggcgtggtggtgcatgcctgtaatcccagctactcaggaggctgaggaaggagaattgcttgaaccagggagttggaggttgcagtgagccaagagcccaccactgcactccagcctagagacagagcgagactccgtctcaaagaaaaagaaagctggctgggcgcggtggttcacgcctgtaatcccagcactttggtaggccgaggcgggtggatcacaaggtcaggagatcaagaccatcctggctaacatggtgaaaccccgtctctaccaaaatacaaaaaattatccaggcgtggtggcgggtgcctgtagtcccagctatttgggaggctgaggcgggagaatagtgtgaacccgggaggcggagtttgtagtgagcccagattgcaccagcctggggacagagtgagactccgtctcaaaaaaaaaagaaagctttttttttcagagctgcctgaggttcacggccaaattaagcagaaggtacagagagttcccatgtacctctgcccccacacatgcacagcctccctcacaatcaacatcccccgctggagccgcacatttgttacaactgaggaacctacagggccacatcatcaccggaagtccagggtttccatgagggttccctcttcctgccggatgcttcacgcgttcgggcgaatgtataatgacttgtctccaccattagggttttatgcagaatagtttttgttttgttttgttttgtttttgagacggagtctcgctctgtcgcccaggctggagtgcagtggcacaatcatggctcactgcaacctccgcctcctgggttcaagcgatcctcctgcctcagcctcctgagtagctgggactacaggggtgcgcccccacatctggctaatttttgtatttttagcagagatggggtttcgccatgttggccaggctggtctcaaactcctgagctcaagtgatccacccgcctcggcctcccaaagtgctgggattacaggcataagccaccgcacctggcctagagttatttctctatttgactactaaaggacatcttggttgcttccaggttttggcagttatgaatagacgtgctttggttgtgtgaacataaatatttcactcctttgggtgaataccaaggagcaccgttgctagactacatggtaagagtatgtttagttttttgtttgtttgtttgtttgtttattttgagacggagtcttgctctgtcaccctggctggagggcggtggtgtgatcttggctccctgcaacctccgcctcccaggttcaagcaattctcctgcctcagcctcatgagtagctgggattacaggtgccggccactagacctggctaatttttgtatttttagtagagacacggtttcaccatgttggtcaggctggtctcaaactcctgagctcgtgatctgcctgccttggcctcccaaagtgctgggattacaggcgtgagccaccgtgcccagtgagagtatgtttagttctgtaagaaactgccaaactgtcttcaagagtggctggaccattttgcattcccaccagcagggaatgagagttcctgttgctccacttccttgtcagcatttggtgttgtcaatgttctgaattttggccactctaataggtgtgtggtgttacagttgttttaatttgcatttccctgatgacatataatgtggaacgtctttttgtttgcttgtatgcccacctgtgtatcttttcttgagaaatctgttaaggtttttggtccatttctcaatcaagttatttgttttctttttttcttttttcaagatggagtctcactttatctcacccaggctggagtgcactggtatcatcttggctcactgcagcctctgcctcccaggttcaagcgattttcctctcagcctcccaaatagctgagactacaggcatgtgctaccacgcacagctaattttgtatttttagtagagagagtttcaccatgttgaccaggatggtctggatctcctgaccttgtaatccgcttgccttggcctcccaaagtgctgggattacacacatgagccaccgcaccccgcctatgttgttgtttattattttactttatttcttatagagatagggtcttgcctcattgcccaggccagtctcaaactcctggcctcaagtgatcctcccctctcagcctcccaaagtgttgagattacaggcatgagccaccatgtctgggtgtgtttttattttcatttgtctctaaacattttctaatgtcccttgttatttcttctttgatgtatgttgtttaatttccagagttttgtaagttttccagttttccttctgataatgatttccttccttccttccttccttccatcctttttttaacagtcttgctctttcgcccaggctggaatgcagtggtgtgatctcagctcactgcaacttctgcctcccaggctcaagcaattctcctgcttcagcctcccaagtagctgggaccacaggtgcgtgccaccatgcctggctaatttttttttttttttttgagatggagtctcgctctgttgcccaggctggagtggagtggcacaatctcagctcactgcaacttctgcctcccgggttcaagtgattctcctgcctcagactcccaagtagctgggattacaggtgcccaccaccacacccagctaatgttttgtgcttttagtagagatggggttttaccatgttggccaggctcgtctccaactcctgacctcgtgatctgcccacctcggcctcccaaagggctgggattacaggcgtgagcctaatttttgtatttttattagagatggggtttgccatgttggccgggctcaaactcctagccccagatgattgggcacagtggctcacacctgtaatcccagcactttgggaggccgaggtgggtggatctcctgaggtcaggagtttgagatcagtctagccaacatggcaaaaccccatctctactaaaaataggaaagttagccaagcttggtggtgggtgcctgtaatcccagctacttggtaggctgaggcaggagaatagcttgaacacgggggagggcggaggttgcagtgagccgagattgcaccacttcactccagcctgggcaaaagagcaagcctccgtctcaaaaaaaaaaaaaaagatagtgagtgagttctaatgagaggtgacggtttcacaaggggctcttccccctttgctcctcactcctctctctcttgccgccatgtgagaaggtccaagcttccttcccctttgccttccactatgactgtaagtttcctgtggcttcccagccaggcggaactgtgaatcaattacacttctttcctttataaattacccagtctcaggtatttctttatagcagtgagaatggactaatacacccgtcatccatctctggtcccatctggccttcagacaattggatggtgccctctcccgaccctgtatcgaaggtagatagatcttccccactcagtccactgactcactaccaacctcctctagtttctggggaaatactatcacagacagacccagaaatgatactttatcagctatttagaaatcccttaatccagtcaaattgacacctaaaaatagtcatcacagtccataaatgtatagaattgttatattttcttgcggtgttaaaccttttgttactatataatgtcctatgtctcttgtgactttttaaaaattttttgttttgttttgtttttgagatacagtttcccgctctgttgcctacgctggagtgcagaggtgtgaccacagctcactgtagccttgacctcccaggctcaaatgatcatccacctaggcccctcaagtaggtggggcctgtgccaccaagcctggctaattttttttttgagatggagtctcaccctgttgcccaggctggagtgcagtgttgagatctcagctcactgcaaactccgcctcccaggttcaagcgattctcctgccgcagcctcttgagtagctgggattataggcgcccatcaccacgcccagctaatttttatatttgtaatagagacggggtttcaccatgttaaccaggctggtctcaaattcctggcctcaagtgatccacccgccttggcctcccaaagttctgggattacaggcatgagccactatgcccagccccactgtcctttcttcaagttcactgattcttctgcctcctcgaatctaccttcgaatccttttagcgaaattttctttttttgttgttttttttcttttcttttttgagacagagtctcgctctgttgcccaggctggagtgcagtgggtgatctcggctcactgcaagctccacctccagggttcatgccattctcctgtctcagcctcccaagtagctgggactacaggcgcctgccaccacgccaggctaattttctttttttttgtatttttaatagagacagggtttcactgtgttagccaagatggtctcaatttcctgacctcgtgatccgcctgcctcggcctcccaaagtgctgggattacaggcgtgagccactgtgcccagcctgtttgttttttttttttcttatgagacagggttccctctgtcacccaggctagggtgcagtgacgtgatcatagctcactgctgcctcaaattcctggactccagtgattttcctacctcagccttctgagaagctgggattacagctgtgtaccaccatgtacagctaatttgtaaatttatttatttttttcttttttgggacagggtttggtgggtttggctctattgcccaggctggagtgcagtggcgcaatctcagctcactgcaacccctgttttctgggctcaagccaccatctcacctcagtctctcaagtagctcgaactcctgacctcgtgatctgcctgcctcggcctcccaaagtgctgggattacaggcatgagccacttcgcccggccgattcttgtctttctccatggttttttgtttttgtttttgtttttttgttttttgtttttttgagatggagtttcactcttgttgcccaggctggagtgcagtggcatgatctcagctcaccacagcctccgcctcccgggttcaagccattctcctgcctcagcctcccaagtagctgggattacaggcatgcgccaccacatctggctaattttgtatttttagtagagatggggtttctccacgttggccaggctggtctcaaactcccgacctcaggtgatcctgcagatccgcccacctcagcctcccacagtgctgagattacaggcgtgagccacccgacgggctccatggagttttttgttattgtttttgtttgtttgcatttgtgtttattgtttttgtaagctgtctctgtgccaaagatcagcctgaaataccatcttaatgaaccctctagcttttctgagtctgtgcctttctctggccatgcactgcgcagtcactttctaattttccttgtatgtgcagtttttttttgagtttctaatcttttttttttgttgttttggagacaaggtctcgctttgtgtcccaggctggagtgcagtggcgcaatctcggttcactgcaacctccacctcccaggttgcagcaattctcctgcctcaccctctctagtaactgggattacaggcgcctaccaccactcctggctaatttttgtatttttagtagagacgggggtttcaccatgttagccaggaggctgttgaactcctggtctcaggtgatccatctcccttggcctcccaaagtgctggtattataggtgtgagtcatagtgcctggccgaatgttctgatctttaatgtctggctcccaaaaaggaaaaaaaagtagtgggggcagggcactggccctttaaatcacctggtggtggcttgagttggaaggggaggagcctaccccagttggggaggagcacaacctccgtggcttcttgcctcttcctctgcacctccaggatctgaagcagtgtttccggaaagtctctcaaaccctgtttgtcctctcctctcataccaccaccacaatcatcaacacagaagaaagcttctgtggccaaatttgtggagttttccccatacaccaagcagaagagccagttgagcgtcccctagtccagttctgaggctaactggagatagcatcagatcccatggagtgagggcgcactccccaagcctcccccgtcacagccccacacaccagtcccacgttggggcccctggaacttgtgacctacaagcttcaagttggggttcccacatccccctctttgggttctgttaatttactggggcagctcacagaacacgaagacacacttccttacatttactggttcattgtaatggatacagatggagacatctgtggtgttatatatatattttgggtttcatccttggttcctggctcttagttcccatagcccttgttacagtctttggatagaatgttgggtgtggccaggcgcagtggctcatgcctgtaattccagcactttgggaagcctaggctggtggattgcttgacctcaggagttcgagacagcctgggcaacttggaaaaacacggtctctacaaaaaatacaaaaactggcacggcgtggtggtgcactcctctaatcccagctactcgggaggccgaggctggaggatcacttgagtctgggaggtggaggcttcagtgagctgagatcgagccactacactccagcccgggcgatacagccagaccctgtctcaaaaataaaagaatgggccaggcgtggtggctcatgcctgtaatcccagcactttgggaggccgaggcaggcggatcattatctaaggtcaggagttcaagagcagcctggccaacacggtgaaaccccatctctactaaaaacacaaaattagtcaggcatggtggcgtgtgcctgtactcccagctactggggaggctgaggcagaagaatcacttgaacccaggaggcagaggttgcagtgagccgagatcgggccatgccattggactccagcctgggcagcagagtgagactctgtctcaaaaaaaaaaaaaaaagactgttgagtgtgttaggtctcagagtcaagcctcatacatattacaaaggaggatacagataaagagagctatagctatagaactataaatacagctatagggaacacgtatggcacttccatgccctaccccaggggttgaagttctgtgaatcttgtccttagggtttttttaattttaatttttatttttttttgagacggagtctcactctgtcgcccaggctggagtgcaatggtgcgatcttggctcactgcaacctctgcctccctgtttcaagcgattctcctgcctcagcctcctgagtagctggcactataggcgcacaccactatgcccagctaattttttttgtatttttagtagagacggggtttcaccatgttggccaggctggtctcgaactcctgacctggtgatccgcccacctctgcctcccaaagtgctgggattacaggcatgagccaccgcgcctggccgtttgtttttgagacacggtctggctctgtcacccatagtggataacagtggcccgatctcggcttactgcaacctcagcctcccaggctcaagcgattctcctgcctcagccacctgagtagctgggattataggtgcacaccaccacgcccctcttatttttttttttttttttgagacggagtctcgctctgtcacccaggctggagcgcaatggcgcgatctcggctcactgcaacctccacctcctgggttcaagagattctccggcctcagcctcccgagtagctgggactacaggtgtgcaccaccatgcccagctaatttttgtatttttagtagagacggggtttcaccattttggccaggatggtttcgatctcttgacctcgtgacgtgcccaccttggcctcccaaagtgctgggattacaagcgtgagccatcatgccccgccttatttttgtatttttagtagagacaaggttttggtatgttagccaggctcctggcctcaagtgatctgccccacctggcctcccaaagtgttagcatatggaagcttcagagttcagcattccttcccccagggtatagggcctctctggggagggtccaaagcctcacaatgagaaaggtggggaggattaaagtcctgccttggggcagatgaaaggagggaaggagaaggtcagaggtctgtccttgaggctgaacactcccagcgttgtatgaaaagactggactttgcagtgtctcatgcttgtaaccctagcactgagggagaatccctcagcccagcagttcgagaccagcctaggcaagatagggagatctcatctcaaatttaaaataaataaataaataaataaataaataaataaataaataaaaggccagtctcagtagctcacggcctgtaatcccaacgctttgagacaacgagtcaggtggatcacttgaatcccggaatcccggaattcaagaccagcctgggcaataaagtgagaccctgtagctacaaaaaatacaaacagtagccaggtgtggtggcatgtacctgtagtttcagctactcaggaggctgaggtgggaggatcaatcgcttgagcctgggaggcagagattgcagtgacccattctgcgactgcactccagcctgttggacagagccagactctgtctcaaaaaaatttgaaaagagactataacaaggtctttaggagttatcaaccaggatctgtgcacaaatatatatcctaaccccacaggcagcagtcagttatcacagcacagatgcctgttatctggaggacaggctgcatttgcccactctggctcctgcaagctgtgtgcaagccggtccaggaccacctgcatctactgcctgctttgcaggctgggctgggaaatgggtagctgccaaactgctaagagctgaaattgagcaaaattaactgcactttaccatccaagccttcccctggaagttacaagccttcagtagactccagagtttcaaaatagtcacatcaggcagattctgccagtgtaattgtttaggcaggaagaccatttcctgatgtttccttctctgccatcttgatattatcttttgcagagcagtttttattgattgattgattgatttgcgggggttatttttaatggaggccagcttagcaattatattttttagcataatgttttcaagatttatccatattgcccttcattacttttcatagctgaatagtgttccaattgtatccatataccacattttgtttaatcattcatcagctgatggatcataagttgtttctactttttggctgttatgaatgcagctatgaacatttgtgtatatatttttgtgtgaattgtgggcatgtgttttcttgttttatttatttatttatttatttatttatttatttatttttgagacggggtctcactctgccgcccaggctggagtacagtggcgtcatctcagctcactgcaacctccacctcccgggttcaagtgattccccctcctcagcctcccgagtagctgggcgggcgcgtgccaccatgcccggctaatgttttttgtatttttttttttgagagagtttcgcttttgctcctaggttacagtgcagtggcgtgatctcagctcgctgcaacctctaccttctggtttcaagtgattctcctgcctcagcctcctgagtagctgggattataggcacccaccaccatgcccagataatttttgtattttttagtagagacggggtttcaccgcattggccaggctggtctcgaactcctgacctcgtgatctgcccgcctcagcctcccaaagtgctgggattacaggcgtgagccactgtgctcggccttgttttttgtatttttagtagagacggggcttcaccatgttagccaggatggtctcgatctcctgaccttgtgatccacccctcggtctcccaaagtgctgggattacaggcgtgagccactgtgcctggccagtttgtttttgtctgtttgttttgagacaaggtctcactgttaccgaggctggagtgcagtggtgtgatcatggcaagctacagcctcagcttccttgattcagacaatcctcccacctcagcctcctgctggtctggaactcctgggctcaagtgatctcacctcaacctcccaaagtgctaggattacaggagaggagtgaaccactgtgcccagactttttttttttttttttttttgagacacagtctcactctgtcacccaggctgtagtgcggggacacggtcacagctcactgcagccctgcctcccaggctcaagcattcctcccacctcagccatctgagtagctggactacaggcacagcaaccatgcccagggaatttttgtgttttttgtagagatgggggtcttgccatgtcacccaggctggtcttgaactcctgagctcaagataacctcccatcttggcctcccaaagtgctaggattacaggtgtcagccaccacagctggctgggcatatgttttattatttatttatttatttatttatttatgagacggagtctcgctctgttagcccaggctggagtgcagtggcccgatcttggctcactgcaagctccgcctcccgggttcacgccattctcctgcctcagcctccccagtagctgggactacaggcgcccgccatcacgtccggctaatttttttgtatttttagtagagacagggtttcaccgtgttagccaggatggtttcgatctcctgacctcatgatccgcctgcctcggactcccaaagtgctgggattacaggcatgagccactgcgcccggctgacccaatatttcttatcgtctgtctttttgctaatagccatcctagtgggtgtgaagtggtatctcattgtggttttatttgcatttctgtgatgactaataatggtgaatatcttttgatgtgtttattagccatttgtatatcttctttggagaatgtcaatttggatcctctgctcttttttttttttcaattgactttatttttagagcagttttaggttcacagcaaaattaagtggagggtacagagagctcccgtccaccctcctgtgctcattttgtaatggtgcaacagcacaaaagtctggtcatggatgctagcttcatgcccatcacaggtggcagtgagtgctcctgctccaaacgtcctcactccgggacacacgctgatgaagtttctcttctatggcatggggaagagaaagaggaagtggcaggttccccactgactatttaagccttcagccagagataacaggtcacctctactcacattttagtcgcaaagcaagtcattcagcaattcctaactttaagggggtgtgaaattctcccgtgatcctggaggagagggtctgaatatatgtggccacccctaaagactcacgggagttaaataaggttcttttgtgcaggacttgtcactgcatttcctgggccacctggcaggtggcaggtggagtagcgccgacatacttgactggggaacccttctcttttttttctttctttttttttttgagatggagtatcgctctgtcacctaggctggagtgcagtggcgcgatctcggctcactgcacctctgccttctgggttcaagcgattctcctgcctcggcctcctgagtagctgggattacaggcgcgcgccaccatgcccggctaattttttgtatttttagtagagatggggtttcaccgtgttagcccagatggtcttcattgcctgacctcatgatccgcttgcctcggtttcccaaagtgctgggattaccggcgtgagccaccgcgcccagcctgggggacccttttctcctagagcatctcatgggacatgtgttctctggaatcccatttgggaaccactgtcttggctggtggctacttcctaaaggaggggttgacaaactttctggaacggcccagtaagtaaatattctaggtttttcagaccatatggaccaattactcgattctgctgttgtagtgcaagagccgccgtatgtaatatgtaaatgaatgggtgtgcctgtgttccaataacgttttatttatagacactaaaatgtgaatttcatacaatttttctgtgtcacaaaatattatttttcttttgatttttttccaaccatttataaatgtgaaaaaccattcttagctcatggactgtacagaaacaagtggtgggcgagatttgacccacaagctgtgggttgctcaccttgtcctagaggacagagtcccagcacctttgcctggcattcaagccccgtcaccttccccagttccatcatctaccacgtctccgcacagagctcaagcatggccatggcagatgtttttctaggatcaaatcacactctttcactctcggggccttttcccagtctgttctcccttctggaatgtccttccagctcttctgtccccagctttgcttgggaacagtggggcctcccttgatctgggaggaatctggagcttctgacgctggtggctccctcacttcctggcgctgcagagtcagccgccccccgccccgcccccgtgctgtgttctggagctctgtaggtgtgtttgcttccccagccacaccatgagcttctggagggtggggactttggcctcctgagttctgatcccccaggcctgctatcgttggaatgtttccccaaaaaagcacaagttggaaactgaatttccagtggaacagtgttgggtcgtggggcctgatgagaggtggttaggccgtgagggctctgccctcatgaaaaaaaattagctgggcctggtggcgggtgcctgtaatcccagttactctggaggctgaggcaggagaatggcttgaaaccgggaggcggaggttgcagtgagccaagatcgcgccactgcactccaacctgggtaacaagagcgaaactccatctcgaaaaaaatgaaaaaattaaataaaataaatttatttctgttctttattaattgcccatctcaggtattctgttacagcaacacaccattgactcagacagaaaattggtatggagaactggggctgctgctgtcacaaacacctgaatatgtggaaaggctttggaactgggtgatgggttaagcctggaagaattcggaggagcaggctagaaaccgccgacattgccataaagggagcattcggaggattctggtgagggctcagaagagaacagctacagggagagtggaaaacttcttagagattgcttaagtgataatgaccagaatgctggcgggaatgtggacagtggagtcttctgacaggtctcagatgaaaatgagaaacaaggtattagatattagaggaggggtcatccttgttattacataaagtggcaacaaacttggccatattttgtctatgcctgatgattttatgaaaggcagaattatttttcctttttttttttttttttgagatagggtctcgctccattgcccaggctggagtgcagtggtgcgatcatggctcactgcattcttgacctccctggttcaggtgatcctcccacctcagcctcccgagtagctgggactacaggtacacaccaccatgcccagctaatttttgtatcgctttagagactgggttctccctatgttgcccaggctggtctcaaacgcctgggctcaaacaatcctcccacctaagcctcccaaagtgctgggattataagcatgagtcaccaggcccacccagaaggcagaattgaagagccttgaactgaaatctctaagcagcaaagcactgaaagagacacttggcttcttttaactgtggacagcaaaattagagaaaagagaaaggatttttttttttttttttttttgagacagagtttcgcttttgttgcccaggctggagtgcgatggcgagatctcagctcacggcaacctctgcctcccgggttcaagcaattcccagcctcagcctcccgagtagctgggattacaggcgcgtgccaccacgcccggctaattttgtatttttagtagagatggggtttctccacgttggtcaggctggtcttgaactcccgacctcaggtgatccacctgcctcggcctcccaaagtgctgggattacaggcgtgagccactgcgcccagcccgattttttttttttttgacagggttttgttcttgtcgcccacattggagtgcagtggcatgatcttggcacactgcaacatctgcctcttgggttcaagcgattctcctgcctcagcctcctgagtagctgggattacaggcatgtgccaccacgtcaggctaattttttgtatttttagtatagatggtgtttctccatgttggtcaggctggtctcgaactcccgacctcaggtgatccacctgcatcggcctcccaaagtgttgggattacaggcgtgagccaccctgcccagctgaaaaatgatttaaagatgaaattataatgaacagggaagccaaatggggagatttggaaaatttgcagcctggccatataaagcatgaaaggcatgtttaggagagcaaatcaaggctgtggccaagccgccactttcgggttttttttttgagatggagtctcactctgtcgcccaggctggagtacagtggcatattctcgggccctgcaacctccacctcttgggttcaagcaattctcctgcctcagcctcccgagtagctgggactataggaccatgccaccatgcctggctaactttttgtatttttagtagagatggggtttcactatgttagccaggatggtctccatctcttgacctcgtgatctggttgtctcggcctcccaggctggcccgggtgccgctcgactcactgctctggaaagtacaacctgtaaaccttagtggcaaccatgtgctgctaattctgcaggtgcagattgcaagagctgcggggccatggtctcctccaccgagatttcaaaggatgttacctacagcctgggggcccaggcagagactttttgttgaggtggagccactgcagagaacccctaccagggcagtgccttgtggagatggaggacagtgaggctgtccccaagacaagaactgtaggctgggcccggtggctcatgcctgtaatcccaacactttgggcagaagaggcgggccgatggtgtgagctcacgagtttgagaccagcctgggcagcatggcaaaagctagtctctacaaaaaaaatacaaaaaattagctgggcatggtggcaggcacctgtaatcccaactactgaggaggctgaggtgggagaggattccttgagcctgggaggcagaggctgcagtgagccgtgatcatgccattgcactctagcctaggcaacaggagtgaaaccctgcctaaaaaaaaaaaaaaaaaaaaaagatttaatgctgtctgcctactcggctttggatttacttaggaccagttacttcttctttctttcctgtttctcccttttggaatgggaatgtttagcctatgcctgtattttgaaagtagataacttctttgatttcacatgcttgtggctggagagaattgacctcaggatgaacggtgcctgcgtctcacccatctctgatttaggtgagactctgaagtctcaacttttgaattggtgctggaccaagctatgactttggggctattgggatggaatgtattttgaatgtgagaaagacatgaatttggagcatgaattccagggatgaaatgctagggtttgaatacattccccaaaacacatgtgtagaaacttgatccccagtgcagcagtgttaggacatggggcctaatgggaagcgttcagatcaacaggcattgctcttgggaatagtttaatgccatttttgagtgagtgggttttttattgtgggagagggttcatgatataagggcgcattcagtccccttctttctctctctttttctcttctttgtacctttcatgaagtgcaaagtcttaccagatgcaggcccctctattttggactttcagcctccagagcagtgagaaataaatttctgttctttgtaagttacccatatcaggtattcagttacatcagcatataacacactagttcccgtggggtgttgcaaaagtcacttctggctgggtgtggtggctcgtgcctgtgatagcattttgggaggccaaggctgggaggatcacttgagtccaagagtttgagaccatcctgggtaacatagtgagacaagatctttactaaaaatcaaaaaattagctgggagtgatgatgtgcacctgtagtctcagctactcgggaagctgaggagggaggattgcttgagcctgggaggtcgaggttgccaggagccatgatcacgccactgcactccagcctggatgacaaaatgagaccccttctcaaaaataaaaataaaaaataaaatgaaaaagttacttcctctctcgggacctcagtctccacgtctgtcagatgggagcaatgtctcctgccctggatgcctcctgaggttgttctgagggtcgaataaggctggccccaaaggaaccatgaccagcagagagctgaccttggaggataatggctgacaccactggaatttcgttttggggcactgatcctgtgctaggcaccttcagaagtgaccaagagcagaaagcccaggccctgctgagagggggatgcagcgtggtgacataaaatcctgttgctgtgtccccagcacctgggacaaaatgagacttgggggtattggagatgactcgaggaacctagatgaacctcaggtgtctgggagctcccagactgtcaggaagaatgacatcaacaccaaaccctgccctgagttaccgcattgtcctctagggactgggcactgaagcttcctgcagcagacaaaatttgggtctggatctgagccaaaagccccctcatttataaatggggaaacatgacttcacattgatccaaaaataaaaaataaaaataaaaaataaaaacaggccgggcgcagtggctcgtgcctgtaatcccagcactttgggaggctgaggcgggtggatcacctgaggttgggagtttgagaccagcctaaccaacacggagaaaccctgtctctactaaaaatacaaaatcagccaggcatggtggcgcatgcctgtaatcccagctactcagaggctgaggcaggaaaatcgcttgaacctgggaggcggaggttgtggtgagccgggattgcgtcattgcactccagcctgggcaacaagagtgaaactcttgtctccaaaaaaaaaaaaaaaaaaaaaggaaactgaggccctgagaggtccaggggctctcaggcagccagaggcagcacctgacctggcccaggcccccttccccgggagcacagatgccaggatgtgtggattggcgcccttcttgggctgctgggccccgtggtctgctaattagtcacatcatttttggcatcgcacacagcctcgggaactggagaatgtcattgtcaaagtatttttgaatatttgccttctcagcaagaagatgagaaagctgtgaggacactcagtcttccacggggtggatactaaccaaaatcacaagcagcttgagctggaaggacctgggagccgggagagatgccggaggagtcccgcgcgctgcctgtcacagctgtgtgacttcgagacagggctctggccccctgggcctcagtgtcctcccctggaaaatggctcattcatttctcaggtgggcatgaagttgctatgtgccacgcactgctgtaggctctggggagcaaaacaggcaaaaatctctgctctcacaggctgccatccccaggggggccataccatagaaatcaaatcagatacaccaggggtgacacatagaagggagagcccaggggtggggctgtcagggatggccttgctgagaaggtgacatgcgagtgagaatttgaagggggcaggagggagcccaaggggtgtcaggggaagagccctccagcacagggagcggcaggcacaaaggccctgcactcgggcaggactgggttgttccaggagcatcagggaggccaggcgggctagagcaggtggtgactcagggaggcaacatgacaagactgggtcacaaaaggccactggaggcctgcttgctgcttgtggagggccttgtaaactgctggaaagcctttcttttctttctatttttgttgttgttgttgttgacagggtctccctctgtctcccaggctggagtgcagtggctagagctcgctgttacttcaaactcctgggctcaagtgtgtgccaccatgctctgcacccaggctggagtgcaatggcgccatctctgctcactgcaacctccgcctcctgggttcaagcgattctcctgcctcagcctcctgagtagctgggattaaagctgcctgccacctgcacaggtaattttttttgtatttttagtaaagacaggattgcgctatgttggccaggctcgtcttgagcccctgacctcaggtgatctgcccgcctcccaaagtgctgagattacaggcgtgagctgcacctggccttaatttttaaatttaatttaaaatttttgtttttgttgttgttgcagaaatggagtctccctatgttgtgcagacaggtcttgaactcatagcctcaagtgatttgtccgcctcagcctcccaaagtactggacttacaggtgtgagccatgacacccagccaaacctatggtttttttttttggtgttgttgttttgttttttttttttttgagatggagtcttgctctgtcgcctggactggaattcagtggcgcaatatctcggctcactgcaacctccgcctttcaggatcaagcgattctcctgtctctgcctcccgagtagctgggattacaggtgcatgctgccatgcctggctaattttttgtatcttagtagagacggggttttaccgttgttgcccaggctggtcttcaactcctgagctcaggcaatccacccgcctcagcctcccaaagtgagccactgtgcccgaccaagcctatgtttttgttctgggtgacggtctagagcaggaccagacgtgatatggtttctgtattagccgtattcttctgtgccccatgcttcaaagatagaagcaaggaggccaggtgagatgtgaggaggcctgccccatggtggggacagtgggggaacgagagaggactggactccagatgtgtctggaggcagagttgacattgggtgtggaattgtaaaaaataatttgttggccgggtgtggtggctcacgcctgtaatcccaccactttgggaggctgaggcggatggatcatggggtcaggagatcgagaccatcctggctaacatggtgaaaccctgtctctactaaaaatacaaaaaacaagattagccgggtgtggtggcaggcgcctgtagtcccagctactagggaggctgaggcaggagaaatgcgtgaacctgggaggcagaacttgcagtgagccgagattgcaccactgcactccagcctgggcgacagagcgagacttcatctcaacaacaacaacaaaaataataataataataaatttttctttttttttgtcctccctgcctcatccctgtaatttattttattttactttattattttttttgagacagagtttcactcttgttgcccaggctggagtgcaatggcgtgatctcggctcactgcaacctctgcctcccgggttctagcaattctcctgcctcagcctcctgagtagctgggattacaggcatgcgccaccacgcccggctaattttgtatttttagtagagacagggtttctccatgttgaggctggtctcgaactcctgacctcaggtgatccgcccgcctcggcctcccaaagtgctgggattacgggcttgagccactgcgcccggcctataattttttttttttttttttttttaagagacagggttgtcaggcacggtggctcacgcctgtaatcccagcactttgggaggccgaggcaggtggatcacaaggtcaggagttcaagaccagcctggtcaagatggtgaaaccccaactctactaaaaatacaataattagtattgtatttttacatacattttaggggtgaggtggcagacccctgtaatcccaactactcgggaggctgaggcaggagaattgcttgaacccagggggcggaggttgcagtgagccgagattgcaccactgcattccagcctgggtgacagtgagactccgtctcaaaaaaaaaaaaaaagaaaagaaaaaagagagacagggtcttgctgtattgcccaggctggagtgcagtggctattcacaggcacaattccgctactgatcagcctgggagttttgacctgctccatttccgacctggggtggtggttcacccctccttaagcaacatggtggtcccctgctcctcggaagtcaccatattaatgccaaagttagtgcggacaccctctcggcatagcgcactacagcccagaactcctgggctcaagcgatcctcttgcctcagcctcccaaagctgtgtgagccaccacgcctggccatttaaatcattttcaaatgtacaattcagggacatacagtacattcacgatgttgcacaaccatctccacagtgaagttccagcaggaaacccatgtccatgaagcaggcactcccttctcccctccgtgtgctaggccagtgcagggagagacatgatatggggctgccagcaaggcagatgctaggggaaattgagggagatggctggaggagaagagggtcttcggctatcccctgcgtcactcccaggagccccaagatgtgtgcgcagcagaggagactctgagacacattctcctctagaccaggcactgctgaacactggagcagtgcaagcaggacggcaacaccaagaggtcctgggcggggtggggtctggggagggagagagatacaagaaccaagagtcccagggctgcagctgagacagggctggtaatgaggcacagccccggagtgggcaggggtggggacctcccatggatgggatggtcagaaggctcctggaggaggtgacatgtaggtggggtaaggcagaggaagcctgggaagattgggggaaaggtgttcccggcctagaaacagccgaatgccagcaggcctctccgtgtcacacccctgcctcctagggccatccatctctctgtctgtctgttccagggagggttccccggtttgtcttttactgaaagatcctggaggaggggagggctagttgttgctcttatgcaaaggccctgaggcaggtgcagggtgtgaaggggaggggagacatgaggccaggagtcgaagtggagctggaggcagggccatgcctcatgtgcctggggccagctgtggagtgtttggaatttcatccttggcccacaggaaatccccgtagggaccgggggtgggggtggggggtggtgggggttgtaagccaggaaggaagtgatccagcccttgtttcaaagatgatctctggctgtcatgtcattaggggatggcagttggaagggtgtcgtggtatctaagctggtagaggaaagagtacggcccaggtatcccacctcccagggcaccctcgtgtcactcttgacaggcccagtacttgcagtgtcctggggaaaagccccatgtgtctctcatctgtgaacgagaggtgaatggaggcccatctagctgggccaggcctgaccatccgcaggactgaatgccagcaagcctttccacgtcccacccctgcccactagggccatccgtatctgtctgtctgtcccagggagagttccctggtttgtcttttactgaaagatcctgggggacgggagggctagttgtcactcttgtggacaaggggtaggtcctcagccaggaaacctttctttttttttttttgagatggagtcttgctctgtccgccaggctggagtacagtggcacgatctaggctcattgcaacctccccctctcgggttcaagcgattctcctgcctcagcctcctgagtagctgggaagacaggcgcccaccatcacgcctggctaatttttgtatttttagtagagacggggctttaccatgttggccaggctgaccccgaactcctgacctcaactgatccgcccgactcggcctcccaaaatgctaggattacaggtgtaagccactgtgcccagcccaggaaaccactcttggaaggcagtttctagacagagaaaagaacacccttttctctgagggtctaaatgttggtgtagccggtatctgtctgctgcgaggctgctgggaagccagtgctctgctcattatctatatccctgccaatatatctacactcttactggggtctggtttaaatgtcccagcctgaccccaagacaaagtcagcagtggtgactgaagcagcccttgctgcgtggcaggctctgtgctgggcacgggattccagacacacaagagtgagaccctatcttgcagagcttacaattcggggtgggggcaggggggagggaaacacaagtagccctaagcatggctcatgacaactgtcatcagtgccaggagtggggacaccagggcctgggacagggggctgaggcggtcaggaggttcagaagggctcctggagaagggggcctgcgagctgagctgtgaaggccaaggggcatgatctgggtcgcgtggcctggtgggagcctcacccctgggcaatcctgggaagagaggtcccaaaagtggggaatcttgaggccagcttaggcaggaggccctctcctctcctgggcagagacctgcttcagcctaggtctgagctctgcccgagctggtcttcccacatgcctgcggccccttgagggaggcctcacactggtcccaggcctgctgctgccgtccgcccatgcctcacgggaagcttcttagacagagtgaaaagcattcctaagggaatgtaaagaaagggcggggcggctgggcaggaaagggcctggctcacacttcccctcgataatcttatcgcgatgacaagctcccagcctggcctccatttgttcatctggaccgggagggtgccctggctgcaaggctggagttaggattgacataaccgtaaagtgtggacgtgacccaccaggagcatggggatgaggactcctcggggtggccttgtgggaacggggtggggcacccacactggccttggcaccctagcaaaggtgtgggtgtggaaagccaggcctgaagtctcaagtcctggcagggaggccatctcctccaacaccctggcaaatgaaggatgcaaaggaaacgaaatctacagaaacgcggagaccctgaatgatgtgttcttctgtgtcttcttcctcctcattctttctgttatttaattatctctattttccaaacagcttccttgagatataattcatagtacatgccatacaattcacccatgagaagtgtccgatacagcagttttagtatatccagagtcatgcaaccatcaccacaatcaatgttagaacatctcgccgggtgaagtggctcacggttgtaatcccatcactttgggaagctgagggaggtgaatcacgaggtcaagagatcgagaccatcctggccaacatggtgaaaccctgtctctacaaaaaattagctgggcatggtggtgcgcacctgtattcccagctacttgagagactgaggcaggaggatcgcttgaacccaggaagtggaggttgcagtgagtcgagattgcaccctgagatcgcgccactataccccagcctggcgacagggactccgtctcatacaaacaaaaaaacaaaaaacaacaacaaaaagaacatctcattacctcagaaagaaaccctgtacccatttgcagtcactccacattcctctctccctcagcaaccaataatctgctttctgcctgttgtggacatttcatagaaatggaatcatacactatgtggtcttttgtgactagcttcttcatttaacctgttcaggattcatccatgttgtagcatcctttttatggctgacccatattccagtgtggatagaccacactttgtttaaacattcatcagatgagggacattaagtatgaataatactgctatgaacatttgcccacaagtttttgtgtggacatatgttttcagttgttttgggtatatatctctgagtgggatttctgggtcaaatggcaactctatgtttaacttcttgagaaactgccagactattttccaaagcagctgcaccattttacattcccaccagcagtggcttccagcacttgttactgcatctttttgatgagtgctatcctggtgggcaagaagtggcatctctttgtggttttttcatttccctgacggctaacattgagcatctttgcatgagtttcttggccttttttttttttgagacaggagtctcgctctgttacccaggctgcaatggggggcgatattggctcactgcaacctctgcctcccaggttcaagtgatgctcctgcctcagcctccaggtagctgagattacaggcacccaccaccgcgcctggctaatctttttttttttttttttttttgagacggagtctcactctgttgccaggctagagtgctgtggcgtgatctccgctcactgcaacttccgactacctggttcaagagattatcctgcctcagccaccccatagctgggattacaggaatgcaccaccatacccagctaatttttgtattgttagtagagatggggttcaccatgttggccaggatggccttgatcttctgacctcgtgatctgcccgctttggcctcccaaagtgctgggattacaggcgtaagccaccgcatccagccacagctaatcttttttttgtttgtttttttgagacggagtttttgctcgttgcccaggctggagtgcaatggcgcaatctctgctcactgcaacctccgcctcctgtattcatgtgattctcctgcctcagcctcccgagtagctgggattacaggagcctgccaccatctgcagcaaaatttttatctgtaggagagacgcggtttctccatgttggttaggctggtctcgaactcccgacctcaggtgatccatccgcttcagcctcccaaagtgctgggattacaggcgtaagccaccatgctcacccacacaagttttaatttttatgaattccaatttttctcttttgttccttatccttttggcatcgtaatcaagaagactttgcctacctcatggtcacagagatttaggttttcatctgacagttttatagttttacaattaggtcttacaattaggtctacgatttacttgcttagttattaacatattaagtaacaagttctagcagtgggtctaataacttctgtgattttggagacgagtatacgtgctattttgaggctgggcgcggtggctcatgcctgtaatcccagcactttgggaggccaaggtgggcggatcacgacgtcaggagttcgacaccagtctggccaacatggtgaaaccccatctctactaaaaacacaaaaattagctgggcgtggtggtgggtgcctgtgatcccagctactcagagcctgagggaggaaaatagttggaacccgggaggttgcactgagctgagatcatgccactgcactccagcctgggcgacagaacaagactctgtctcaaaaaataaaataaaaataaaataaataaataaatgctattttgagatatttccagtgactgcaatgtgttgagatggaatatcacctacattcataagtgaagaaaatgctggattttggttaaaggttgattttttttttgagacaggggtcttgctggaggcctcaaagtacctgggattataagtgagtgccaccgcacttggtgttaaaggttaatttaaataaagatgtatttaccagctctggttcatggtctccagaattctatccatggattccaggttcagaactcttaggatggctaaaattccagcctgaagtctcagttttccaatagtcctttgggggcttgaaacctcccaggaatggctttagggtgttttcctgacacttcccagccctggcccataccctgccctctgcctggctccattcttgggaaaggaattccttgccaaacagaattttctaacaagcccaaatatagtaataataataattagcagcaggaagaactataaacactggggtaggaaagcctgtacccgtctctccttttcctgatcccttcccttcattcctgaactgaaggagacggagcccctttgggctttgatgactccatcactggggtatgttcatttgatggttgattttgctgtaccaggtacttcctttcccattttctaatcattttataacacatgctgactcttttcccttccctttttctgggaaaatacaatgaatacaaaattataaacactgtatgtttagcatcagaccaagcatgttgcagacacccttgcccctggccgtcccagaatccctggggcaactctggccttggttaagaggctccatagctcctggcttagctgtgccccggctcctcccctcatatcatgcctgatcctaggaagatatttcacttctgggtgcctcagctttctcatctataagggtggggtatgagatggtcatggtcatagtttttgtttttttttagggtggggggacgagatggtcatagggtcacagtttttttttttgtttttgttttatacagacgggatctcgctatgtcaccgggcgccatggctcaagcctgtaatcccagcactttggaagtccgaggcgggcggatcacgaggccaggagttcaagaccagcctggccaatatggtgaaaccccgtctctactaaaaatacaaaaattagccgggtgtagtggcgggtgcctgtaatcttagctactcgggaggctgaggcagaggttgcagtgagcccagatcgtgccactggactccagcctgggcgacagagtgagactctggataaaaaaaaaattaatgaaaggaaaaaggcaaggaggaatcccaacgatgacaggttgaaagctgcagaggagactgatggggagtgacctgtgaggtagcaggaccaggtgaactggaatccccaggtccagataagtgagggtttccaggaggaggagtggtcgactcagctgctgctgagaagctcagcgagaccaagaagtgacccccggattgggcagcggagaggttgtaggttaccttagcagcagttaaggggtggggacacagccctgctggatggggtgatgagaggctgggacgggaaggggtggaggaggtgagtgtagggaagtctacagaaatgtctgaagggagggagaaatggccagaggcaggagagggtttgggggcaggagtcggtccagagtgaggctgatggcacagaaaagcctcgaggggagggcagcgggatggggtcctaggcctgaggaggacgtgagtacccgacagggaagtttgtctgtttgggtactgggagaggagaaagatcctgaaggctttcgtttttctctgaagaatgaggtaaggccacgggctaggagcccaggcagaaggggctgtgggaggtgtaaggagaggggagcaggcatgaggtctcactttcagagtgggagtctcaccgaaaaacatgatagggctgccggctttgtggatgcgttagaagtgtgggatcacaaattcccaatcccagggctgtgtgtggagccctctccccaagcgatgggaaggcgagtgtccttaacgttggggttccctatgctggaaggatggactctattacagtccatcaggccaggaggtaggtactgtttcctgtattttacggttggtaaatctgagagcttcaggccaatacagtatcggtgtagcattagggtcagacaaaatagaacagggcccggcacatattaagtgttaatattcgttggaaaaaaaaaaaaaagaatgcttgtcaagtccactgctgcgcccctactggtagcccagcctggcctcagccttgggggctggtgggtggagagggcggccttgtgtgctctgctatccctattgccttaatgacccagtatcacctttgtgcccttgtaggttgatccttctagtctcgtggcagaactttgtagacaccaagcgagcggggcagcgtgttctggacctcattcctcacacagggctcacctccggatgagtcagaggccttagccggtggcccagccccgggaatgccaccccggttctgtaccctgcccaggccagctgacagggtgtattggggcacacacctgcagcatccagggcactccaaggagagggacgtacttttgaggagagtctaaaagtctaagtcccccacctgaacttggtgggggaagggcttctataccaggagggctcccagccctgtttcttaaaggccatttaggcagaagtgaacgtggtctcttcaataaagttaataatggttcatgctgcagaaaatgttcaagacaaaaccctgcttatttactcaggctttaaaaccataaaactcccaaattctccctgtagctatttatatccagagctagtccccaaattaagctcaggtttgaagtaacttaaaagaaaaatagccttccctgctttaaaaagattttccgtatagacctccactggtctaattacgaagggcgcgtagtttcagggttggctgggggtagggcaccgggacctccaaggcagttacactcctcagcctcctaacagctgtacggctgcccggtggtccctctccaaggcagcggctctcaggctagcctcagcctaccccacccgcccgcaccccgtgttctccctcgtgggggtgccggggggagtagggaggcggggcgggcggcaggtccggaaaagtggctgccctcgccccgaaagaagttgaccctcctcccgtgccgagagcttgggatgaaaatagcttcttcctctttacccttcctggacccccgccccaggacgactgggccccttcattcatctttcagcggccacccaggcggcttgggcgtccccacgccgggactctgtgccccggggacccacggggaccctcccttgggcctctgaagccgcggcgcaccccgcacccaagccaccccgggggccccggcctcccccacccaattagcgggcagcaccgcagacccgagtccccacgcagctcgcgccaggggaggcggccgcctgggaagcccgtcccccgcgccgcggcccccgcccccgccagccccgcgtcccctgggaaaggcgggggcgcagcgagtttcccccaattagtttcctctttgtatggagtcttagcgcgcccgtactcctccgcgcagcggaaagtagtcccggccgggcgctccgcggcttcccagcgccagacacattttactttgagaagtcgacgggactctcagcggggtccttcagatggggggccagaggctgcgggaggcgtgcgcgggcagcaagggcaggggccgcggccaagggtagggggcggggagggccgcgaactcctcgccgctgcctggagagatggatcatggggcgtagggagatggcaaacctcaaaccacgtacggcgggcgatacgcgtcaaccgaacctcgccaacggaagcccggagccgcccctccccgctcccccgccccgccgccccggacggacgggcgcgcggagccaaccccgctgccgctggctgtccaaatcccaccagagccaatgggagcgcgagggggggcggagccatctcgcgtcagttgggctgcgcgcccccctcccccggcgcccctgcaggccccgcccctgcctcctcccctctccgctcgctgctcccggagtagttggtgccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtaggtggcagccgcccccgcggccccgggccccgcgccccgcgccgcgctgaccgccgtattctgcttcccccgcaggtggcggtggcatgagggtcggaccccagtaccaggcggtggtgcccgacttcgaccccggtgagtagcggccccggccggccggcggcggggatgagcgggagccccgggtccccggcgagcccgagggggcgggagcccgccgacaactttctttttgtgcgttcgccctgccgtccgtggggagaacagcagggcgaggacgaggaggcgcacacgcacacgagtgttctgcaaacgtgcctctgcacccgggggaggccaggtcgcccccagcagggccggcgccgctgcccccttgcgcctccgaggactgcgggtggcgtcggaggtggccacacctggcctgggggcgctgggggtccctgcgtccaggtgagctgcgcctcggccaggggtaagggtggcagtgccggagagttagtgtcctgcgagcgccccggacttaggaggtccccagagacccctttctcggaacccttcccaaaggctgctccccacgcctttgctcctcctctcagcctctgggctcttgctggctcctgactgccctcccatccagaaggcgagtagaagaacgaccccccaaaaccagtcaataaaagaagtgtgttttccagagggcgcctgcctggggaagagagtctcgcgtgtggcagttggattttaggacctatttgtaaatgtgtgtatttccttttttttggaggaagagattgtgaaattgagaagcatcagaagctttagcctaacaaatgcttttcacctacaagaaagccctacaccctagaatggaacacttagttccctggctgctattctgtgtagaagcaaatttaaagtggtacaagaaaaaaaatccgatcagacaaaggaattcgtcagattttaatgcatgagattctagccagtgtctgtatgagactgtctttaaaggttgttggtatggaaaatgtttgaaagaacgtaggatttatttcagaaataaaattcaaaagagcatcttgtaaagctggagttaacaatcctccatggttggagggctttagagctggggttctgtatgtgggttataccactagtttatttgaaaagataaacgcatacatgttttttccttggaaacaagactgcagaaaattgcaatgatctagtccttgaaaaaggcgattgctctcaagctgttattaaggtactaaactgcactttgaagtgaaaatacatagaggtcctaggtgagctcttggacactctggaaataaatgacttcctaaattggccttctaaattttgatttgttgacgtaaatctgttaaatttatttgtctaatactcgcgtttgtgtttcttttaagtccatgttagtgtttttgatagtttcctcttctccccaattcttttttttttttttggtagtcacttctcgtttatgagtgacaggatagaactaggtggccaggctatatctcttgtatgcttggctcctccgttccttggttggccaccaggggaagcatactgttttttggttacagttgaccctgtcttcattttgtaggtcaagtctatctttgctttaaaacacagaacataaagcttgttaccaaattttcctaatgtattatttttaaaaatcgacttccacaaatctttgagtaagttggtaggctttttgatacatttttgttaacataaattttgaaaactttatgtagatgtgttggatgtgactaaggaaaagggcatatttgtcaacaacaggaattagatttctgacattcatcgaaatattgacatcagctctgcattgttagtaatgagtttgacttctttggagttatacttttctttgaaacagcaaatataatattttgaactgtctttgggctttttgttggaatagatatgagcataaacttgctagtgaccagctattctaaaatggaaaacatttatcagattgcagtagctcacacctgtagtcccaacacttggggaggccaaggctggaggatctctggagctcaggagttggagaccagcctgggcaatgtagtcagactctgtctcaacaaaaaataaaaaaattagctgggcatggtggcatgtgcctgtagtttcagctacgggggggtctgaggctggaggatctctgggaagtcaaggctgcagtgagcagtgatctggccattgcactccagcctgggtgacagagtgagaccctgtctcagaaataaaaaggaaaacatctaactgttttgctgcatagtcttgctgccaattggttgagtattgatattaaaatttccaaatttcttttttttttttttgagacggagtcttgctctgtccctcaggctggagtgcgcagtggtgtgatctcagctcactgcaagctccgcctcccaggttcacgccattctcctgcctcagcctccagagtagcagggactacaggcgcccaccaacactcctggctaattttttgtatttttagtggagacggggtttcaccgtgtcagccaggatggtcttgatctcctgacctcgtgatccgcccgtctcggcctctcatagtgctgggattacaggcatgtgccaccgcgcccggccccaaatttctttattttgtgtttgttttaatctggaaaggaatctaactggtgtaaagtaatttcaaaccttgttttgccaacctaagcagggggacacagttttctagatatggcagaaaattgagactttactatttcctagtggttttttatgtgtcttttcatttaacttaaaagcttaaggggaaggaaggcttccattttggaatagaaatgatacaacattttttttttttttaatacggagtttcactcttgttgcccacgctggagtgcaatggcgtgatctgggctcaccgcaacctctgcctcctgggttcaagcaattttcctgcctcatcctcctaagtagctgggattacaggcatgcgccaccatgcctggctaattttttgtatttatagtagagacagggtttctccatgttgatcaggctggtctggaactcctgaacgcaggtgatccacccacctcagccttccaaattactgggattacaggggtgagccaccgtgcccagccaactgatgtttgttttatagcaaaattctttcttagctgtttaagacttaagacaggttctttccatgactgcaatttaagagtagtgaattgagtaataaattaagaattgagagtttgatccttactagtttttatttcctcctcctacttgtttttttcttttttcttttattttttgagaccaagtctcactctgttgcccaggctggagtgcagtggcacgatcttggctcactgcaacctccacctccgaggttcaagtgattctcctgcctcagcctccagagtagctgggattacaggtgcccaccaccacgcccaactaatttttgtgtttttattagagatgcggtttcaccatgttggccaggctggtctcgaactctttgcttcaggtgatctccccgccttgtccttccaaagtgctgggattacaggcgtgaaccactgtgactgcccctccccccgcctttttttttttttttgagacggagtcttgatctgttgcccaggctggagtgcaatggcacaatcttgactcactgcaacctccatctcccaggttcaagtgattctcctgcctcagcctcccaagtagttggaactacaggtgcgtgccaccatgcctggctaatttttgtgtttttagtagagacggggtttcaccatattggccaggctggtcttgaactcctgacctcaggtgatctgcccccctcggcctcccaaagtgctgggattacaggcgtgagccaccatgccctgtccctacctcagttttgagtgtgtctttgttcttctcttttactagaatttgaacagagaggtggacgtgaaacttaacaggcagctttttttcttttctttttttattatagtaaaataagtaactatggtagagatgcatgaatggaggaatttgactttgattttttttttttgagacagagtctcgctctttcacccaggctggagtgcagtggcatgatctcagctcactgcaacctccatctcctgggttcaagcgatcctcctgctgcagcctcctgagtagctgggattacagacgcacaccaccacacccggctagtttttgtagttttagtagagatgaggtttcaccttgttggccaggctggtctcgaactcctgacctcaggtgatccacccaccttggcttcccaaagtgctgggatttcaggcgtgagccactgcgcccgaccttttttttttttttttttttttttttgaaatggagtctttctatgttgcccaggctggagtgcagtggcacaatcagctcacacagcctctgcctcccgggttcaagcagttctcctgcctcagcctcctcagtagccgggattacaggcgtgtgccactatgtctggctaattttggtatttttgcaattttttttttttttgagatggagtttttttctcttgttgctcaggctggggtgcaatggcatgatctcgatctcggctcacctcaacctccacctctcaggttcaagcaattctcctgcctcagcctcccgagtagccgggattacaggcatgggccaccacacccagctaattttgtatttttagtagggatagggtttctccatgttggtcaggctggtcgtgaactcccaacctcaggtgatttgcctgccttggcctcccagagtgctgggattataggcgtgagccactgcgcagccctaattttggtatttttggtagagatgggtttcaccatgttggccaggctggtctcgaactcctgacctcaggtgatccactcacctcggcctcccaaagtgttgggattacaggtgtgagccactgtgcccggcctgatttttttgtcagattttacttatttgcggtatgccagcttgaccctatttaggtttgaaagcaaatggttggagctaagactatctgatatttcctatgcagttcaaaggaagatttaattctgtcatgccttacaaagagtgaatgaggtggatagagcacgttagtcttaaaatcctgattcagttcttttttttttttttttttgagacggtgtctcgctctgttgtccaggctggagtgcagtggtgtaatccgggctcactgcaagctccgcatcctgggttcatgccgttctcctgcctcagcctcccgagtagctgggactacaggcgcctgccaccacgcccggctaatttttttgtattttaagtagagacggggttccaccatgttagccaggatggtctcaatctcctgacctcgtgatccgcccgcctcggcctcccagagtgctgggattacaggcgtgagccgccacgcctggccctgattcagttcttataaaataattaatacctagattagatcggtgtagtgtggcattgcttggtagttagaataccatttgtgtttacactgaaataaaaagttttaccaacttttaaagagttaaaaaaaaaaagagttaaaaacctaagtgcagccctacacttttaacttaggctttgttcttacatgtgttgtccagactgcctttccatgctgtctgccgcagattatgctgagttgtcattggtttcttttaatattcagtagttacagaataatagggtaagaggggggatgcttatctatcctacctctggttggttctttcctacataagcaaagcatcacttattttgaaatgaataatgtttttctttccttttttttccttttttttttgagatagggtcacactctgtcaccagtatagtggtgtgatcatggcggcagtgaacttgaacctcctgggcgcacactatcctcccatccatactttacctcgaaagtagctgggactacagatgtccacgaccatgcctgactagtttttttgtattttttgtagagacaagagttttgccacgtagtccaggctggtctcgaactccttggctcaagccatctgcctgccttggcctcccaaagtgctgggcttacaggtgtgagccaccgtgttcagccattattattactattttttaattttttttattctctttatacacgtccttggtgcttcagaggcgtacattgttaatgatgaatatttttgagatagtggccctttaaaaaagcaacctttattttgaatgtttaatccaatgtatttaatcagatctgaaaatttgtggttgtcattggcttaactgtcacttcagagttgacttctgtcagaaaactgtgttatgttttcatgtggaataggtaattttactgaacagggtgtcttgatatgcctttcatttgttttcactggtgattctatgttctgctttttttatgctttagatcattgtaaaaaaaatatggtgaatgctttgtggttttgttttgttttgttttttttttttgaaacaaggtcttgctctgtcacacaggctagagtgcagtggccctgatgttggctcacttcaacctctgcctcccagactcaagtgatcctcccccctcagcctcatcagttgctgggaatacatgtgcacatcaccacgcttgagcccaggctggtctctaactcttgtgctcaagcagtcttcctgccttggcctcccaaagtgctgggatcacaggcatgtgcctggcaatgctttgtgatttatttatttaattattattattatttttttgagacggagtctcgctctgtcacccaggctggggtgctggagtgcagtggcgcgatctcagctcactacaagctccgcctcccgggttcacgcccttctcctgcctcagcctctctgagtagctgggattacaggcgcccaccaccacgcccggctaattttttatatttttagtagagatggggtttcaccgtggtcttgatctcctgacctcgtgatccgcccacctcggcctcccaaagtgctgggattacaagcgtgagccaccgcgcccagccagtgattgattgattgattttagttttattttttattgtattttgagacagagttttgctcttgtcacccaggctggagagcaatggtgtgaccttggctcactgcaacctctgtctcccaggttcaagtgcttctcctgcctcagcctcccgagtagctaggactacaggtgtgtgccaccatgcccagctaatttttttttttttttttttgaagacggagtctcactctgttccccaggctggagtgcagtggcgtgatctcagctcactgcaagttccgcctcctgggttcacgccattctcctgcctcagcctcccgagtagctgggactacaggtgcccgccaacacgcctggctaattttttgtatttttagtagagatggggtttcaccatgttagccaggatggtctcgatctcctgacctcgtgatctgcccgtcttggcctcccaaagtgctgggattacaggcgtgagccaccgcgcccggctgctaatttttgtattcttagtagagatggtatttcgctggctgggcatggtggctcacacctgtaatcccagcactttgggaggccgaggcaggcggatcacttgaggtcgggagttcaagaccaacctggccaacatgatgaaacccctctctactaaaaacacaaaaattagctgggcgtggtggtgcatgcctgtaatcccagctactcagaaggctgaggcaggagaattgcttgaacccaggctgcaaaggttgcagtgagcgtagatggcaccactgcactccagcctaggtgacaaagtgagactctgtctcaaaaaaaaaagacggggtttcactatggtggccaggctggtttcgaactcttgacctcaggtgattgacccgccttggcctcccaaagtgctgggattacaggcttgagccaccgcacccgaccaaacactgatttaatactaggcaatatttgcttcaggtacagctaaagcctcattcccgccttctttcttcattaattcacagttggtttatattatttctgtgatagtttgcatcttctgagaagcagatgacaagacagaattagatgtgcaagaggttcattagggtatgcttgtgaaggataaagagaggaaggaggtgtaggtggcaagagcctttacactggaagcatgtgtgacacctgtgaaagaagagagggaaggaatgatgattaatgattgatagaggaacctcaaactgcagtgcagcttgcagttcagagaaaatctcagccagagtagattgttagaagagtctgttgggcaggaatggtccttctttgtgaacatctgctgtgttcagtcattggctgggagcagcctagagtagcctagccttggtatgggtgctgtagtagatttctggtagctggggctgtcagttaactacactccttgcaacattttctctcttgaagggaaatctgagtggcacactcaaggctgtcagaattcccatacgtgtttttgtacttaaatacatgtgtgtaattccagcactttgggagggtgaggcgggaggatcacctgagatcaggagttcgagaccagcctggccaacatggcgaaaccccgtctctactaaaaatataaaaattagctgggtgtggtcgcgggtacctgtaatcccagctacttgggaggctgaggcgggagaattgcttgagcccgggaggcggagattgcagtgagccgaggttgtgccactgcactccagactggacgacagagctagactccgtctcaaaaaaaaaaaaaaagtgataatatgttttcttgttattgttagtgtttttgtaaatggaataatctatgctattcatgtacttttatgctttccaaacaagtacatttccactagcaaggtaaacaactttgttttcaccttgtcttcgtcatggtgttagttaggttattaattttttttaaatgctatcctttaatggcttatattagcatttttttcttttcttttcttttctttttttttttttttttttggagatggagtttcgctcttgttttgttccccaggctagaaatgcagtgacgcagtctcctctcactgtaacctccgcctccccggttcaagtgattgtcctgcctcagcctcccgtgtagctaggattacaggcatgtgctaccacgcctggctaattttaaaaaatatttttagtagagaaggggtttcaccatgctggccaggccggttttgaactcctgacctcaagtgatctcccgcatcggcctcccaaagtcctaggattacagacgtgatccactgtgcctggcctcttctttctttttttgtagacttgatatcgttctgcctcttaggctggagtgcagtggcatgatcacagcacactacagcctcagcctccagggctcaagtgatcctcctgtctcagtttcctgagaagctgggactacaggcatgagccagtatgcctgactgatttttgaactttttgtagagacggggttttgccaagttgcccagactggtctccaactcctgggctcaaccagtccttctgctgtgtcctcccaaagtgttgagattacaggcatgagtcactgtgcctgtaattaagttttccaattaatgatgaggttaagtgtcttatgtttttaatttttaatttttaatttttttaagaccttttttttccccttttttgagatgagttcttactcttgtcgcccaggctggagtgcagtggcgtgatcatagcgtactgtagccttgaacttctagggctcaagtgatcttcatacctcagtttctggagtagtttggactacagttgttcaccaccacacccagcaaagaatgtgacaaaaagtactaagtgtgttttagctaagtatcgataagaaaagagtgtctttttatttattttttatttgtttatatgtactttttgagacagggtctggctctgtcatccaggctggagtgcagttgtgtaattttggctccctgcatcctcagcctctcaggctcaagtaatcttcccaccttggcctccggagtagctgggtttataggctcttgccactatgcccagctaatatttgtattttttgtagagatggggtttcaggttttgttggtcttaaccctggcccaggggtgtctgtaaatttttttttcttttttttgccactcagtttcctcctgtgaatgtatctttcttttgctatttttcttttttttcccccttagggtcttgctctgttgcccaggctggagtgcggtggcttaatctcagctcactgcaaccttcatctcctgggctcacatgatcctcccacctcagcttccgaggtagctgggactacaggagtgtgccaccacgcctggctaatttttgtgtttttttgtagagacagggtttcaccatgtttcctaggctgttttgctgtttttctatagggtgttggtttttataggttttggttttttgtatggatttgtgtgagttctttttatttatatatttggatattctttgttagaattgcacatatgttttttgttttttctttaatattatgtgtgttgcggggaggaggattgagtttatttgactaggaagggataaaaatacattcctgactggagactgtactcagagattggtcttggtgtatacccctgatttctaagatgaatgttactgagaattgacaattttttttgttgattgttgtgtttccactaagttattcatctcattttggcctgctattagctagttgacccaaatcacagtgctggatgacttgaaaagctctgatttaatttttgcctagtatatagttatagtagcatataggttaaaggttaaagttacagctttgatcctataatggtcagttagtttcccacgaaaggttaaaatgctatagactaaaactaacagctgtcttagggatttgccactccttataaggcaatgggtagtgtgtggatagggaggtacaacttgtcatcactaacaaaaccctcgaaagaatgatctatccaggttgcttactctgtgccaggctagttttaacacacatcaaatcatttgaccctcacaacagtcatatgatgtaaagttactatctccattttccagatgaggaaacagaggcattgagaggcttagtcttatggttgaacctaataacttgccgtggtaatccagtccgagaggccctcagctgtaagaggcacctttattttatgtttcagtaagaaaggaaaaggatcaacaagatagactgttaattttaagtattataagaattctgatttataagtataatcagaattcaatttagtgtattttagagagggtcagccagaatcctctttaagagaaaacacttaggctgggtgcagttgctcactcctgtaatcccagcactttgggaggctgaggcaggtggatctcccaaggtcaggaattcaagatcagcctggccaaaatggtgaaaccctgtctctactaaaaatacaaaaaattagccaggctataatcccagcattttgggaggctgaggcgcgagaattgcctgaacctgggaggtggagctacagtgagccgagatcgtgccactgcactccagcctgggtgacagagcaatattccatctcaaaaaaaaaaaaaaaaaaaaaaggaaaagaaaaaacacttaggagcaagactttattggatccattgattagttgtttccatgtggccccaggtgttggggaattttatgtttcgggttgccagagccaacttgtagtccagttacattcctcttcttcctggcagtgagaacaccggtgaaatgggaggtggttagcttggttgcctggggacaaattggactgagttgctttattcctgcatgtatgttgaaatagtcatcttcacaacttagaatatagttggagttttttttagaagagccatttattttgatggtgtgactgaaggctatacatacagtcatgtattgcaaaacaaatgtcattttggtcaaggacagtggtcccataagattataatggaactaaaaaatttctgtcgcctagtaacttcaccttgtctatagtgcaacagcgtgtagcattacttaggtgtttgtgtggtgttggtgtaaacaaacctactgcactgccagtcttacaaaatctagcacatggagttatgtatagtacatagtacttggtaatgacaataactgtattactggtttgtggatttactatgctatactttgtatggttattttagagtgtattcctacttataaaaattatcagtttgctgtaaaacagcctcaggcaggtccttcaggaggtattccagaaggaaggcattgttactctagaatatgacacctccatgggtcttattgcctctgaagaccttccagtgggacaaggaaggtatggagttggaagatggtgatattgatgatcctgactgtaggctaggccaatgtgtgtgtctttgtggttttttttgtttttgtttttgaaatggagtctcgctctgttgcacaggctggagtccagtggcatgatctcggctcactgcaacctctgcttccctgcttccagtgattctcctgcctcagcctcgtgaatagctgggattacaggtgcgcgccaccatgcctggctaatttttgtatttttagtagaaatagggtttcatcatattgggcaggctggccttgaactcccgacctcaagtgatctgcctgcttcggcctccgaaagtgctgggattacaggcatgagccaccgtgcccggcctaatttttgtatttttagtagagacggggttttgccatgttggccaggctggtcttgaactcctgacctcaggtgatttgcctgtcttggcctcccacagtgctgggattacaggtgtgagccactgcacctgactgtatttacacccatactctccctgaaggttgtagttcctgccctgctttacttttactggcatagaagctgctgggcttggtgttctgctttcaaacttagcgtggatatagggagttcagcggggaggaagagaagagtaggtgcttaactagttttgatcttactcagtaccagagagtgttctgggagctagtggtgtcatgtatgtctgatttctttgagggtggtagcgtagttttttgaaccaccaaatcaggttttaagttttttttttttttttggaggggagatagggtctcaccctgtcccccaggctggagtgcagtggcgggaacatggcccactgcatgcagccttgacttcttgggcaccagtgatcctcctgcctcagcctcccaggtagctgggattacaggtgtgaggcactgcacctggctgttaagtattatctagtataaactcgtcagagctaaataggggctgaattttctaagaatatgtgcttggtttgggtcttttcttgaataggcttttgtttttgtttttttgatttttttgggttttgtgttagtttttttttttttttttgagacgaagtctcactctgtcgcccaggctggagtgcagtggtgtgatcttagctcactgcagcctctgcctcccggattcaagtggttctcctgcctcagcctcccaagtagctgggattataggcatgctccaccacgtctggctgattttgtatttttagtagagacggggtttttccatgttggtcaggctggtctcgaacttctaaccttaggtgatccgtctgccttggcctcccaaagtgctgggattataggcgtgagccaccgcgcccggctgagtaggcattttttaatggacatttgataaggaccaagtgcaactgtatatcaaatggaaatctagggaaaaattgtcttttaaattgcagttaaaagctgattatccctattgtctcttgctttccttataatgaatttgtataaattggagatgcacatcttgcatagatgtgttttcttttttttatataaagtggtgcaagtcacatcacaaaattgactattttttggccaggtgtggtgactcatgcgtgtaatcccagtgctttgggaagctgaggcaagtgggtcacctgaggtcaggagtttgagaccagccaggccaatatggtgaaaacctgtctctactaaaaatagaaaaaagctagccaggcgtggttgctcatgcctgtaatcccagcactttgagaggctgaggtgggcagatcacgaggtcaggagtttgagaccagcctggccaacatggtaaaaccccatatctactaaaagtataaaaattagccgggtgtggtggcacctgcctttaatcccagctactcaggaggctgaggcaggagaatcgcttgaacccgggaggtggaggctgcagtgagctgagatcgtgccactgcacactagcctgggcaacagagcgagactctgtctcaagaaaaaccacaaagtacaaaaaattagccaggtgtggcggtgcacgcctctaatcccagctacttgggaggctgaggcaggagaattggttgaaccggggaggcagaggttgccatcagccgagatcacgctactgcactcaagcccgggcgaaacagagagactccatctcaaaaaaaaaaacaacaaaattaaccgttttacaatgaacaattcagtggcattcagtgcactcgcattgttgtggagccactgcccttgtctagttccgaaacattttcatcaccctaaaaagaaaatctcacatgtgttagaatgaagaatgagttacttcttattctccattctcagtaccaggcaaccactaacctgctttttgtttctggattacttattctggaactttcacgtaaatgggtatgtgaccttcatgtctggcttctatcacttagtgtaatgttttcaaggttcattcatgttgaagcttgagtcagtattggtactttctgtgcttcattgcttttgttttgtgttgttgttttttttgttttgccttgtttttgttttttgagatggagtcttgctctgtcgtccaggctgaagggcagtggcgtgatctcaactcattgcaacctctgcctccctcgttcaagcgattctcctgcctcagcctcccaagtagctgggattataggtgcgcaccaccatgcctggctgatttttgtatttttagtagaaatggggtttcaccattttggccaggctggtcttgagctcccgacctcaggtgatacacctgtctcggcctcccaaagtgctggggttacaggtgcctggcctaattttaaaattttttttttgtggagagacggggtttgtttatgttggccaggctggtctctaactcctgacctcaagcactcctcctgcctcagcctcccaaaatgctgagcttataggcatgagccactacacctggctcattcatttgttgatggacatttagcttgttgttaccttttgattattgtgaaccgtgctgttatgtacattcatgtacaggtatttatctgttttcatccttttaggggtatatatctattagtggaattgctgggttatggagtaattctgtgcttcacttttttttttttttttttttttttaaatttttattttgagacaggctcttgctctgttgcccaggctggggtgacagtggtatgatctcagctcactgcaacctctgcctcccgggttcaagcaattctcctgcctcagcctcctgagtagctggggttacatgtgcatgccactacacctggctaatttttgtatttttagtagagatggagaaacatgttggccaggctcgtcttgaactcccgacctcaggtgatccgcctgcctcggcctctcaaagtgctgggattacagatgtgagccactgtgcctggtctgtgcttaactttttgaggaaccattaaattgtttttcacagtagcttaaccattttatactccatgattaacgtatgagggtttcaatattctactttttattttctgttttttgagatggagtctcactctgttgtccaggctggagtgcattggtgcgatctcggctcactgcagtttccgccttccaggttcaagtgattctcctgcctcagcttcctgagaagatgggattgtaagcatgtaccaccaagtgtggctaattttttttttgtattttttagtagagacagggtttcaccgtgttggccaggctgatcaggctggtcctgacctcaggtgatctgcctgtctcggcctcccaaagtgctgggattacaggcgtgaaaatgctactgatgacagtgcagagagtcctgagatgcttagagtagtggagttactcgatccttccctgtggtggagggttgggagttgaagaaaccaggaagtcctatatgaaatggtcctttaaggccgggtgcagtggctcacccctgtaatcccagcactttgggaggccgaggcaggcagatcacgaggtcaagagattgagcccaccctggacaacatgacaacatggtgaaaccctgtctctactaaacatacaaaaattagctgggagtagttccagctactcgggaggctgaggcaggagaatcgcttgaaccctggaggtggaggttgcagtgagccgagattgcgccattgcgctccagcctgggcaacaagagcgaaactccatctcaaaaaaaaaaaaaagagaaatcgtcctttaagtcaagccttaaaacgtaggaattacctagttaatttgaatattaatattatatgatatataagctgtacatgttataaaaattattttgaaaagtttaatctttaaaattttagtttagattttccttgtagttatctagagctgtgctgtccaatagtgtagccactagctacatataactattgaaatttaaattaattaaaattaaataaaattaaaaattcagtccttctgttacactaggcacattttagatattcagccatcatatatagctagtaggtgccatattggacagctcagaatagagtatttttatcctcccagcaagttcagttgggtggcaatgatctagacattttgatgaaatgaaagcttcattattattgctattattattattatttttgtgtgtgtgtgacagagtgtcgctctgttccccaggctggagtgcagtggcgccatctcagcttactgcaagctcgcccacccgcgttcacaccattctcctgccttagcctcctgagtagctgggactgtaggcgcccaccaccacgcccggctaattttttagtagagacgaggtttcaccgtattagccaggatggtctcaatctcctgacctcatgatccacccgcctcagcctcccaaagtgcagggattacaggcgtgagccaccgtgcccagcccaaaagcttcgttattattaatttttataattcagacgttttgcctcttttgtcaagtgcatgaaatttgagatgggtacagctgagaaatgtatgatggctgtgtgctgaattcctctaggggtgtatttgtttaaatattgccaataaggtgttcaaaataaggttatttgaaagagcaagttgaaatggaaagcttaggagagcttagttttttgtttgtttgtttttttgagatggagtttcgctcttgttgcccagactggagtggaatggtgtgatcttggctcactgcagcctccgcccccacaccattcaggcgattctcctgtctcagcctcctgagtagctgtgattacaggtgctcaccaccacgcctggctaattttttgtattgttagtagagatagggtttcaccatgttggccaggctggtctctcctgacctctggtgatcctcccactttggcctcccaaagtgtagggattacaggcatgagccaccatgcccggcctcagcctatagttcttttaatgcccttgtctactaattctatcatctgtgtcatttctgggtcagtttcagttgcttgattcttttttttcttcctctttttgggttgtcttttccacctactttgcttatctgttgatttttggatgccagacatcatgaattttactttgttggaggctggatatttttgtatttctataaatattcttgagttttgttctgagatgtggttaaaatacttaaaaatagtttgatgaagtcttgcttttaagctctgttaggtgagatcaaaaccattttagtgtagggctaagtatttcccactattgagtcaaaatccttttggggattctgtgtgatagcccatggactatgtggttttccactctggctgtgaggaactggcactcttcctgttcccatgtgagccttgtggattgttccatttgattcttttgggtattttatttatatttttagagaaggtgtcttgctctgtcactcaggctggagtgcagttttgtgatcatagctccttgcagcctcaaactcctgggctcaagccatgcaccccatatagctggggctataccatgcctggttatttttattgttttagagatagggtctcactgtgttgcccaggctggccttgaagactccagggttcaagcgatcatccctcctcagcctccccagtagctgggattacaggattttgccatcacatctggctaagggggtgtggaaccagggacaaagaccaaatacatatttcataatatactacacaaggtaaatctggttcatgtcactctaccttgactggaagcataagtatagattttgccatgttgcccaggctggtcttgagctcctagcctcaagcggtcccctcttcccaaaccttggcctcccaaaggtgctaggattgcaggcatgagccactgcacttcctgagtagctgggattacaggtgcgcgccaccacgcccgctaatttgttttggatttttagtagagacggggttttgggccaggctggtcttgaactcctgctcttaagcgatctgcccgcctcagcctcccaaagtgctgggattacaggtgtgagccaccacgcccggtctgatttttgtattttttgtagggatgggggtttccccatgttacccaggctgctcttgaactcctggcttcaagcaatccacctgcttcggcctcccaaagtggtgggatttcaggagtaagccactgcacccagccttgttcatttcaatattcctgatgaagtactccatctgatctcatttgctcttagaaatctgcttgctggttaccctgtgcagtggctcacacttgtaatcccagcactttgggagactgaggtaggaggattgcttgatgccaggagctagagatcagcttgggcaacatagcaagaccttgtctctacgtgcacctgtagtcctggctacttgggaggttgagatgggaggattgcttgaacccatgggtttgaggctgctatgaggtatgatcacaccactgcattttagcctgagagacaggagacagtatctcttagcaaaaaaaaaaaaaaagaaaaaacaaatctgactaccgtattgatgattctagtccagaattttccaaaggagtataggtggtttttttggttgttgttgttgtttgttttgttttttgagatggtgcgagtctcgctttttttgttttgttttgtttttttgagatggagtcttgctctgtcgcccacgctggaatgcagtggcacaatctcggctcattgcaaccttcgcctcccgggttcaagcagttcttgtgcctcagcctcccgagtagctgggactacaggcgtgcgccaccacgcctggctaagttttgtatttttggtagagttggggtttcaccgtgttggcctggctggtatcaaactcatgacctcaggtggtccgccattctcagcctcccaaagttttggaattacaggtgtgagccatcgcacctggcctttttttttcttttttaaacatatttatttatcatttttttttttttttgagacggagtctcgttctgtcgcccaggcgggagtgctgtggcgcgatctctgctcactgcaagctccgccttccgggttcacgccattctcctgcctcagcctcccgagtagctgggactacaggcgcccgccactgcgcccggctaattttttgtatttttagtagagacggggtttcaccatggtctcgatctcctgacctcgtgatccgcccgcctcggcctcccaaagtgctgggattacaggcatgagccaccgcgccccgccatccttttttttttttttaaagaggtggagtataactatgttgcccaggctgatcttgaactcctggcctcaagcagtcctctaccttggcctcacaaagtgctgggattacaggagtgaaccaccgcgcctggctgagataggttgttttttgaattaactattcttttttttttttttttttttttttgagacagagtttcgctgttgttgcccaggctggagtgcagtggtgcaatgatctaggctcactgcaacctctgcctcccaggtttaagggattcgcctgcctcagcttcccaagcagctgggattacaggcatgtgccactacacccggctgattttgtatttttggtagagacggggtttctccatgttggtcaggctggtcttgagttcccaacctcaggtgatctaccctccttggcctcccaacgtgctgggattataggcgtgagccactgcacccagccatgtttttaagatttttaaacatctggctcttttttttttttttttttgagacggagtctcgctttgtcacctaggctggagtccagtggcgccatctcggctcactgcaagctccgcttcctggattcactccattctcctgcctcagccccccgagtagctgggactacaggcacccgccaccatgcccggctaattttttgcatttttagtagagacggggtttcaccacgttagccagcatggtctcgatctcttgacctcgtgatccgcccgcctcggcctcccaaagtgctgggattacaagcatgagccactgcacccagcccttctggctctttttaaatgtcagatattgataactcccagactgaattaagattttatatgtcagatgattaactatcattttgagttgttgcttagttctctgcttgcttggcaacaggtcagtttccatggtattgccatttttgtaccgcattcttagtggagctgagaggttgggggtgaggctacagggccgaactctataaactagaatagctaaacttttatccagtttggtgtataaaattttttgatatacagctcaggaaaagcatataaaaaacaaaaataaaaataatttctgaataatttttttttttttttgagacggagtctcgctctgtcgcccaggctggagtgcagtggcgtgatctcggctcactgcaagctccacctcccgggttcataccattctcctgcctcagcctcccgagtagctgggagtacaggcacgtgccaccatgcccagctaattttttgtatttttagtagagacggggtttcaccatgttggccaggatggtctcgatctcttgacctcgtgatgtgcccgccttggcctcccaaagtgctgggattacaggcgtgagccatagtgcccggcccccccgcccccacctttttttgagacagagtcttattctcacccagcctggagtgcagtgttaacgatcttggctcactgcaacctcttcctcctgggctcaagtgattcttctgcttcagcctcccaagtagctggaactacaggtgtatgtcgtcatgcctggctaaatttttttttttaatattttttagtagagacggggtttcaccatgttgtcccagctggtctcgaacccctgggctcaagcaatccacccatcgtggcctcctgcagtgctggggttataggcatgagccaccttggcctgcataattcttttttttttttttttttgagatggagtttcgctcttgtcgctcaggctggagtgcaatggtgcgatctcggctcaccgcaacctccacctcctggattcaagcaattctcctgcctcagcctcccaagtagctgggattacaggtgtgcaccaccatgcctagctaattttgtatttttagtagagacagggtttctccatgttggtcaggctggtctccaactcccgacctcagattatctgcccaaccttggcctcccaaagtgctggtattacaggtgtgagccaccacgcctggccattaattcttttttaagaaagagtttcattgctattaaacaagtttgaaaatcacagtttctgcttgagtagaaaatacaaacttgggtttctaccactacactttcacaacatgcttttgactccagatttgaggggggatttctccccaacaggaggtaggccatcagttctgcagtgggcagcagctgggcatcctctaattgaattcagttctgacactgtctacactacccgcttagagatggatggtgacacatcacacaggttgaggactcagtcctatctttgatagtgaacgtaaaccttcatttattttgtctgtggttctgaccagccagctgcaaatttcaagagttcctgcagatacctccttgacttcaattactttgctagagtaacttacagaactcagggaaatgtgtttatccatttattacaaaagatacatgtgtatatgtgtgtgtgtgtgtgtgtgtgtgtgtgtgtgtgtgtgtgtgtatgtgtgtgtgtgtatatatatatttaaattttatttgagttagggtctttccccagttgccaaggctggagtgcagtggtgcgatcacagctcactgcagcttcaacttcttggactcaggctatcctcccatctcagcctcctgagtaggtgaaactatatacacacagcaccatgcccagctaattaaatttttttttggtagagatggggtcttgctgtattgcccaggctggtcttgaactcctgggctcaagcagtcctccggccttggattcccaaagtgctgcaattacaggtgtgagtcatcatgtttggcctacaaaggatatttggaaggatgcaaataaacagtcaggtgaagagatacatatagggccaggattgaaatggtccctagcactggcacttctgtcttcttggagttgggatgggccaccctcccctcacatggctgtgcttctctttactcctgcaatcccccatgtgtttggctccctacaagccatgttcagctccctgcaagctctctgaacccaatcctttcaggtttttatgaaggcctcattacgtagggatgactgattaaatcttttggccattggtgatgaattaaaagttcagtccctctcccctccttggaggttgaggtgggagttgaaaccatttgtcatcctaagctaacaaacggttgccagctattggtcaactcattggcatacaaaaagacacattactttgaagataccgaggattttaggagttgaagggccaggaaacaggaaggccaaatatatatttcacaatatcacaatatgttattaagagcaaatagtgatagaaaagtgaaagtgatgatagcagaaatgtaaagtgtaggttctataaacagtgcagatgagaacaaagctaacagttatcaggcagtctaaatgcatgcagttttttaccttagacacattcgttcgttgactgtttaattgtaaagaaaaatcaatttaagaacatgtatgaaattgcatttatactctggaaaaatgagatgtaagtaggtattttgtattttttagcgtttcaagagcataattccccttatggtatgtctgttgccttgctttcacacattccacttgtgtacatgtttttgggaactcattatgtaagaaagtaatggacttcttacacttctgttaggtaaaaccatagtaattggctgggcatgatggcatggggtgggaggatcacttgaggacaagagtttgagcttgcagtacactgatctttgctgtgaatagtcactgcactccagccggggcaacgaagacactgtctctttcttttttttttttttttttttttgatggagtcttgctctgtcgcccaggctggagtgcagtggcacagacttggctcactgcaacctccacttcccaggttcaagggattctcctgcctcaggctcccaagtagctgggactacaggtgcctgccaccatacctggctaatttttgtatttttagtagagacggggtttcaccatattggccagactggtctcgaactcctgaccttgtgatctgcctgcctcggcttcccacagtcctgggattacaggcgtgagccaccgtgcctggcccaagactctatctcaaataaaaaagaacacagtaatttttctcttttatgggatactacacttacataagtttcttttttttttcttttttttttttttttgtgagacagagtcttgcttttcccctgccaggctggagtggagtggcatgatctcagtcactgcaacctccgcttcctgggttcaagtgattcccgtgcctcagcctcctgagtagctgggattacaggcgtgccccaccacgtctggctaatttttgtatttttagtagagatggggtctcaccatgttttcccaggctgttctcaaactcctgagctcaggtggatcccccctgcctcggcctcccaaagtgttgggattacagtcgtgagccactgtgcctgtctgggatgtttgccatatttgtttcatcagtatatatttctttgcttgggttgagtacagggactgatgcctgtaatcccagcacttagggaggccgaggtgggaggattactggaacccaggaagttgaggctgcagaccaacctaggcaacagagtgagaccatgtcttcagggggaaaaaaaaagcgctgggcatgggcatatacctatagtctcagctactctggaggatgaggtgagaggatcgcttgagcccaggaatttgaggctgccatgagccgtcatcatgcccatgccaatgtactccagcctgggcaagaaagtcgaccctgtctcaaaactaaactaaacaaatttctctggctgaagtttagtaatttgcttttaagtgacgtttgtacattttagaaaataactttgtatattagacatcatttatggtacttaccgttttccatggtcataaaatacctagtctagtgtgataaatgccaggtgatagaggtatgcctggggcataaacctaggggcttggtgggatggggtgagatggttgaaatagtatgtagaaggaaaggctttccagagtttactcttagggtggctcttgaagggcaagtgaaggaaagacatttcaggctgagggaagacacgtttagatggagtcctgtggatggagagtgctggacttgtttgcgaagtcaggagtagtttgatatgatcagatgcttagggaggtgattggtaaagtggtggaaggtgagattgtggaacaggtaggcatggaccctatcacaagcgtcctggcttgtgtatctagctaaaggatctgtctgtctgtctgtctgtctttatattttttgagacggagtttcgctcttgttgcccaggctggagtgcaatgatgcaatcttggttcattgcaacctccgcctcccaggttcaagtgattctcctgccttagccttctaagtagctgggattgcaggcgtgcactacacgcccagctaactttttatttttagtagagttggggtttcaccatgttggttaggctggtcttgaactcctaacctcaggtgattcacctccctcagcctcccaaaatgctgagattacagatgtgagccaccccacctggcccatgcctctatctatctatctgtctgtctgtctatctatctattctatctaatcttttttttttttttttttttttttggagtcaggttcttgctctgttgcccaggctggactgtagtggcgtgatcttgcctcactgcagcctctgcctcccgggttcaagcgatcttcctgcctcagcctccctggtagctgggactacagatgtgtgccaccatgcctggcaagtttttatatttttggtagagatggggtttcactatgttggccaggctgatctcaaactcctgacctcaggtgatctgcccacctcagcctcccaaagtgctgggattacatgcgtgagccactgtgcctggcctgttaagtattaccataaactcttctcctatctgtcttgtaagttatgtacacctcatctatgttcttgatgtagcttgttacttagtctgttatagtaataatctctttaattattagcttttatgtcttctccattgtccactgacagccataactgcgtatatctttttgtatacctgtctacagaccagccatcctaggttgaagaatagaattacttctcattgcttccacagttcctgtcttcctttaaatcatcatgtataacacaaattatacagtagctttcttgtaaatctcctgcttctgtattttatatctgttaggctgggtgcagtgactcacttctgtaatcccagcactttgggaggccaaggtgggaggattgcttaaggccaggagtttgagaccagcctgggcaaaatagggagacaccccgtcaccacacacttatacacacacacacacacccccccacacccaccatgaaaaaaattagtcgcggcggggtgcggtggctcacgcctgtaatcccagcactttgggaggccaaggcaggcagatcacatgaggtcgggagttcaataccagcctgaccaacatggagaaaccccatctctactaaaaatacaaaactatctgggcgtggttgcacatgcctgtaatcccagctaccctggagtctgaggcaggagaatcacttgaacccgggaggcagaggttgtggtgagccgagatcgtgccgttgtacttcagcatcaacaagagcgaaaccgtctcacaaaaaaaattagtcgggcacaatggtatgcatctgtggtcacagctatttgggagactgagctaggaagattgcttgagctcaggaattcaaggctcagtgagctctgattgtggcactgcactccatcccgggccacagagactctgtttctaataaataaataaaatgtaaattagctgttcctctgtggcttacaaccttccagtggctcccatttcacttagagtaaaagtgaaagccctcaccgtggtcccctccttttttgctgctccattactctttctttatctccttcacttcattcagatcattgctcaataaggcctctcctaacctacctatctgcaagtatctctagaatatgacttaaaaacaatctaaacacagatgtcacaactaaaaaaaattaatacttagtccttagtgtcattaaatttctggtcacctattgttaaatagttgctttgtttgaaggtcactgcaacctgcatttcctgagcccaagctatcctcctgtttcagcctcccgagtagcagagactacaggtgtgcaccaccatgcccagctagttttttagaattttttgtagagacaggatctaactgcgttgcctaggctggtcttgaactcctggcctcaagtgatcctctcaccttggcctcccagtatgctgggattacaggcacaagccactacatctagacacgaatttctgatttaaataattctttgtaagaacacttcttaggaggcatttgaatggataactgtcttaactgtcttgcacaccagtctttgtcttttttttttttttttttttttttttgagaaaaggtcttgccctgtcacccaagctggagtgcactggtgcaatcacagcttactgcagccttgaactcctgggctcaaatgatcctcccaccttggcctccaaagtgtttggattacaggcatgagccactgagcccagcctcaggttgtctttctcctgctttactatttcatttttttcttttcgtcttctagcgtactgtaaatttacatatattttaatgtctgtactagaatataagctcaacaagggtagggctctttgtgtgtagacattgctcagtacatagttggcacgaaataaaatcacttaaatgaatgaatgagtgaaatacaaaggcggaatttgactgtaaaacagtcttgttggagaaggtatatggggaataggggaaagagagggcctcttttcgccctcctacattgatacagatagatctcagttggtctctgatcttgtttgtagggattttgttggatgaatgcaaggtgggatggtcttcagattgtaccaatttagctggcattgctaaccaactgttggaatctctgaaaataaaagatcttgaaattcctccccctctccccgcaaagagaaatacgaaggcagacaactgggtaaattgtcctacccctaactgccatccacagaaaagtaacattttgttttatttgattaactgtgcttgacaacattagaaacagtggaaaatcatctgggacttgggcaggtagaaactccagaggtaggactggaggaggggctgtgtaacctctctttcttactcttaagaataacctttttatctacccgagatttattggctccttaaaatcataactaaaacctgtagcctctttcagcagaaagcaatgcttagagtaagacttctactacactgccagcccgaaggcttgaacagaaggcaagtggaagccctaaaactttggctgttcctggcacgattccagtcccactctccctaccctcacccacagcttccccatcactgtctgcttgggaaccgtgagcattgttctcatcttgtgcttctttctgagttatcaggcagccggaaggccagattcccttgtcttccctcttttcatggactctgcattttcttttctgatcctgtttttcaccttgatcttcttggaacttttccctgagcccttttaaactcacggtatatcagcaaaattcccctaatcttcagtttcttctgtgatttccgccccccgccccacacattcttattctgactgaaaataggccatctcctgatgacactgcctccctgcagccctccgaaagagtacttgcctgcccctccatcccttttgtgttactaggcttcacagtagcatgtcctctttttctttgttgccatttctttacttttcttctcgcctccctaaaaacacctctgaatgtgatgtcatgagtttgtactatgcgctcctgatttttgctgcttaatccagtgtgctgtggaggattgaacctcttatgatggagttcccctctttaactctagtaatgcttcttgccttaaagtctgctttgtctaatatcagtatagctatgccagttttctttttgttcgtgtttgaatggcatctttttctgtcttttttattttcaacctttctttattcttgatgtcttggttatgtctgaacaggttttcatccacatcttaaaagcacatctttgcttttaacttgcatttagtttcattcacagtttcatttaatgtatttattgatatatctgtatttagatctaactcagagatttctatttgacccacctgttctgtgtgggtttgttttgttagtccttttgatcttcctttgcattgatttagtatttattgttattcttccctcttccttagcttggtaattgtgtgctatttggaaaaaatactattctctgagtagttatcctagagataacaatttacttcctttatttatttattatttatttatttatttatttatttatttatttattttgagacggagtctcgctctgtcgcccaggctggagtgcaatggcgcgatcttggctcactgcaagctccgcctcctgggttcacgccattctcctgcctcagcctcccgagtagctgggattataggcgcccaccaccacgcctggctaattttttgtatttttagtagagacagggtttcgccatgttagccaggatggtcttgatcccctgatctcctgatccacccacctcggcctcccaaagtgctgagattacaggcgtgagccacagcgcctggccaacttccttaatttattaatctcatgttgacttggcttctcaagaaggcttaagaatcctaaagggaagctgggtgcggtggctcacgcctgtaatcccagcagtttgggaggccgaggcaggcggatcatgaagtcaggagatcgagaccatcctggctaacacggtgaaaccccatctctactaaaaaaaatacaaaacattagctgggcatggtggcgggcacctgtagtcccagctacttgggaggctgaggcgggtggatcatgaggtgaggagatcgagaccatcctggctaacatggtgaaaccccatctctactaaaaaaaatacaaaacattagctgggcatggtggcgggcacctgtagtcccagctacttgggaggctgaggcaggagaatgacatgaacctgggaggcggagcttgcagtgagctgaaattgcgccactgcactccagcctgggcgacagagggagactccgtctcacataaataaataaataataaaataaggctgtgcatggtggctcacggctgtaatcccagcactgtgggaggccgaagtgggcggatcacctgacgtcaggagttcaagaccagcctggccaacatggtgaaaccctacctctacaaaaaatatacaaaaattagctgggcgtggtgccacccacctgtaatcccagctacttgggaggcttaggcagagaatctcttgaacccaggaggcagaggttacagtgagccaagatcatgccaactgcactccagcctgggcatcagtctaaaataaataaataaataaaattcacacctaggacatcacaataaaatagatcgcttgagcccaggagttcgagaccagcctgggcaacctggtgaaacactctctctacaaaaagtacaaaaattagccaggtgtgatggtgcgtacctatagtcacagctacttcggagactgaggtaggaggaacacttgagcctaggaggtcgaggttccagtgagctgagatcttacccctacactccagcctgggtgataggacgagaccctgtctcctcctcagaaaaaaaaaaaaagcattacttaatctcttagcctcttaatggccccctctggaataggcaaataagggggaaactgtgggggaaagcccaatacctacacttcccttttgttttttctggaagtcttcccctttttccccagctggaatgcagtggcacaatcatggctcaactgcagccttaatcccctgcgctcaagtaatccttagcctcccaagtagctgggactacaggtgcatgctaccatacacctggctaattaaaaaagaaaaattatttttgtagagataaggtgttactgtgttgcccaggctggtctggaactcctcacctcaagggatcctcttgcctgggcctcccaaagtgttgggattacgggcgtgaaccactgtgcctggcctgaagttccctttctgaaggcagcagtctctcttgcattccaggtctatcttgttacttttttttttttttttttttttttgaggcagagtttcactcgttcccaggatggagtgcaatggcacgatcttggctcgccgcaacctccacctcctggattcaagcgattctcctgcctcagcctcccgagtagctgggattacaggcatgcgctactatgcccggctaattttgtatttttagtagagacagggtttctccatgttggtcaggcttgtctcgaactcctgacctcaggtaatctccccgcttcggcctcccaaagtgctgggattacaggcatgagcaaccgcgcctggctttttttttttttttaaatagagacagtgtctcactatgttggccaggttggtcttgaactcctggcttcaagcaatcctcttgcctcagcccctcaaagtgctagattacaggcatgagccattgtgcccagttgttacttttctgattccttcaaacagatgttaatattttgttcactttttccagttgttctgtagtgggaggggtctgaatgacttggtttcctagaagggaagtaggtagtttctacctttctgttacgtagtctagtataatttctgtgtcttttcttatttcagtatgcctaatgatattcttcccagagccgctgtgaatgactgcataggttgaacacaacaacacagtgaccctaatccttccgataccttggcttcttagttccttgacctctattcctgggatcctgttctctgccctacctcagccacccattcctttgagttactgttacctgaaattcatacccttttatctctgtttcagacttagcactctacatcctcctgatctttccagctgatgcccttccagcatccctgtgatctttgactccatcatgacgtcagttcattgattataccaccttttcccttgatgtttcttacgcttttgttcagcttaaattccagtcattagaacacaacctctcctcctattcctttgtcttcttgtttcattagttcttttggctatgccacaacctgtgttttactctcattccccggaaaatagagcatacaacaaagcttttactgggctaatactttacttgaagttagaatgaaggggaaaatagaaagtgagacaggaaaggagggaaagcaaatacagagtgctacgttatccagcaggctacagcatcataagaaccttagctggctgctcagtcatgttggaaatctctggagaatcatggcacctctcagaatacttctggggacaggtttgagggaggatggctgagagatttatttgttggctccctctcatatcctgtctcttactggtcagagttgcctgaaggatcttaattattctatacttttgggtttgttacttggcttctctatgcagctgctggaaaagcagctgatttggggtaacagggcttctgccacagcaggcacagtgaggaccaccaaagcctacctgttaacactggggaggtagagaccactagtggtaggctgagttcatatgatcctcccagattgcaggattttgcttgtgctgctgagcctgcttcagctgggaagtagaacagcaggcaggaccgagtggattttggaaagtgtgtatgagctgcatttgttataccttgtgtaatccaactttttgcctattctttgcttgctttcccatagctcaatgtggctggagaaaccatactgatcactctgacttcacagtcatgattaccaagaccaagaggcttttattataggttatagtctgttttcctattccaattactcttctagatagtttaaatgtcttactttaatcctctaattctccctgccttatcctccctttatttcattggggaaaaaacctgaatcaattagaagaaaactactcactccccttaccagatgtgctacctgtctacatctgtgcctggtactctgccttctgtaactgctagctaaggccaaaccctgtgcacgtatactaggctccatgcttttctacctgtttaaggataatcactccagtagttcatcctttatttgcatcatcaaatttttcatctctgttgtatcattcttatcagcgtattaaacgggctattacttcttgtttaaaaacttttttgccgggtgtggtggctcacgcccgtaatcccaacactttgggaggccaaggctggcggatcacctgaggtcaggagattgagaccagcctggccaatgtggggaaaccccatctctactaaaaatacaaaaattagctgggcgtggtggcgggtgcctgtaatcccagttactcaggagactgaggcaggagaatcgcttgaacccgggaggcagaggttgcagtgagctgagattgtgcccctgcactccagcctgggcgacagagtgagactctgtcttaaaaaaaaaaaaaaacacacacacacaccaaaaaaacaaacttcttttggttattctgattctgtatattctttcttttctcctattcttttacacatttcattcaggcttttgcccccactgctcctctagagttgctcttgaggtgatcaattgctccatgttgctaaatccagcaatctgtttgcagtcttcaccttatttgaaatatctaacccaagagacatatgtgtctgtgtgtgcgtgtatatatatatgtatataatatgtatgaagggtttatatatgcataaatttaaaaggggtgtgtgtgtgtgtgtgtgtgtaaaattgaccgacatgactgtgaaggccaggaagtcccaaaatctgcagctggcaatctggaatcccgagatagctgacagggtaagttccagttcaagtccgaaggcacgagagccaggtgagccagtgtctcagctcaagcagtgagacccagaggagttccctcttaaactcagcctttttgttctcttcaggctttctgtgggttgtatgagtcccacccacattaaggagggcagtctgctttactcagtccacggattcaaatgttcattttatctgaaagcactgtcacagatagacccagaataatgtttgaccaaacatctgggcactctatgctgtagtccagttgatgcataaaattaaccattacagaaccttttcttcacttgacatttagaacaggatgccaatatagtccctataagagctagtccctggcttcagctccactacccgctcccccgcttttctctctctctctctcttttctttttttgtttttttggagactgagtcttgctctgttgcccagtgactcactgcaactccaaaaaaaaaaaaagccttactaataaaactcttagcctcttagtggatccctctggaatgggccaataagggggaaagcccaatacctgaacttctcaatgaaaatcctgggttcaaacaattcttgtgcttcagcctcccgagaggtgggattacaggcacccaccgccatgcccggccaatttttgtatttttagtagagacggtgttccaccaagttggccaggctagtctcgaactcctgacctcaagtgatccacccacttcggcctcccaaagtgctgggattacaggcgtgaggcaccacgctcggcctccccttttctctactgcagtcagaggtgccaacttgctctttttttttttttttttgagacggtctcgctctgtcacccaggctggagtgcagtggcatgatctctgctcactgcaaactccacctcctgggcccaagcgatcctcccacctcagcccctccccaagtagctgggactacaggcgtgcgccaccacatgcctggctcatttttgtattcaacacgctgtttcctgaccgtagctggataggcttctgtgttgggggctttgcactcattcatctgcctgaagtgcctccttgctgctgggcacctcctccccatccacatagcccatggccttattcttgccacgtgtactgaaatgtgacattctcatgagggttttcctcatcagtctgtctcagttttcagctgcatccccggcacttcctgttccccttccttgtttttcttttttctcatttactcttatcgtcatctaacacacttccttatttatcttgtttattgtatgattccttcaactagacggtaaactgtgaggtgagaggagagctttttaaaatcttgttgccttaacagcctcccccccccccaccactgcttctagaatagtgcctggtgcaaatttgcctctcagtaacaagttttctgtttatttaaaaatacggacggaatttcgaagctttgtgatagagataaaaaaaatggacaggagcttttcccaggaggtatacaaagtataggtgtctggcctggaactctccacaaagaatacctttattgctctacaaatgctatttgtagtctaaacatggatgagctgatacaattctgaaggcaccttgcagccttctctccttgcttctagctccacgtgtgtgcgagtctgcatatgtgagtgtaagggcagcactgtgttaaagagatttacaaacatctttttaatcctcataacaatcctacaccacacatgtcatcatcccctttgtacagaccataaaactgatatttagagagcttaaacgtcttgcttgaggcctcaagtggtaagtggcagaactcagcttgaagtgacttgactattattacattatatgtgacctcctagataaagagatgcctccttattttgtgtaaggcagaagtggggagtcttgggcagattacttaaccactgctatagtttggatgtggtttgtccttagcaaacctcatgttgaaatttgatctccagtgttggaggtgggccctaatggaaggtgtttgtgccatggggctggaaccctcataaatagattaatgccctcctgggtgaggggtgagtgagttcttactcctttagttcctacaagagctggttgttaaaaagagctggcgcctctctcttgctgcttctctggccatgtgacctcttcacatgctggctccccttcaccttccgccatgtgtggaagcagcctgaggctttcaccagatgccccatcttccagccggcggaatcatgagccaagtgaatttcttttctttgtcagttacccagtgtcatgtattcctttataggaacactaaagggactaagacaacccctttaggtcctaatcatatacatacttatagattcaaagtatctgcttagcatgtactccattcaaagcaactgttcaaaggtaagaatcctatcagggatcagtgcagaaatacgacaccttacacatttctcagctttcaccttcccagagcttcctcggattggtcctcctgttagtttcctggatctgaaggtaatacctcatccagaagataagaagggtagtggggactgtcaccacgaaggagctttccttttctggttcaagttatttcccagctccactcacctccggactgtttcatgaagaattccagaagtccccttctccctcataggaaagtgcaccgaaccactcagatttaatggcttaaaacaactgctggtatttgaggatttgttcaggtgggcagttgtggttctgggctaatgggggccggtgtcatctgcttgctccactgtgatctggaacagctgggccttttttcttggttactgtgtagtctcacgacctctccttttccagtgaggtctgcagtaggacctgatggcttatgcagtggttcagggcaaacattcccagaggaaggaaacagaaactgccagttctttttgaagtgtaggcccagaactggtatatcatcacttctgtcacatttccccgatgactttgtgtctctgaccatcccaaactcactgtgagaagtgactgcatggggtgtgggagtaggtccattgggagtggactagtccagaccttttttttttttttgagacggagtcttgctgtgtcgcctgggctggagtgcagtggcgcaatctcggctcacggcaagcctcgcctcccaggttcacgccgttctcctgcctcagcctcccgagtagctgggactacaggcacccgccaccatgcccagctaattttttttttttttaagtagagacggggtttcaccgtgttagccaggatggtctcgatctcctgacctcatgatccgcctgccttggcctcccaaagtgctgggattacaggtgtgagccatcacgcccggcccagtccagactatttttgagaataaaaaggggcctattaaaaattatgtcaggttgacagacataaactggaactgtcctcacctagtctggacatgtgggtatcattatcatctctacaacttggagaaaacaacacataggtgtgaccttgaatcttgaatctgttttcctgcagttctcctaatgtgaaaatgtgactgcattgagtatgcatgtgatgttttaaattgaatatagcttctaagcagaacccatcaactcttcttttctgttctgttctttacttttctttcttttttttcttttctttttttgagacagggtctcactctgtcgaccaggttggagtgcggtggcgcgatctcgtctcactgcaacctctgcctccagggttcaagcgattctcctgccttagcctcccaagtagctgggactacagactacaagcgtgagccaccacgcccagctaatttttttgtatttttagtagagacggggtttcaccatgttggccaggctggtcttgaactcctgacctcaagtagtctgcacgccttggcctcccaaagtgctgggattacaggcgtgagccaccgtgccgagccaccatcagattttcttggtgggcactgaatgatgacagaaagagtttaatttaacactggagggaaaaattggctttgaatttcctgagaaataatttcgtttgttgggttttttttttttttttgagatggagtctcgctctgtcacccaggctggagtgcagtggcatgatctcggctcactgcaagttgcgcatcctgggttcacgccattctcctgcctcagcctctccaagtagctgggactacaggcccccaccaccacgcccggctcattttttgtatttttagtagagacggggtttcaacgtgttctcgatgtcctgacctcgtgatctgcctgcctcggcctcccaaagtgctgggattacaagcgcgagccaccgcgcccggccagtttgttggtttctaatagagagctttcctgaaggatttttcgttcttttttcttttttcccccctgcaaggggaatttttcaagactgattttgactgcatgctatcctttcctttcctttcctttcctttcctttcctttcctttcctttcctttcctttcctttcctttccttttccttttccttttcctttcctttccttttcctttcctttcctttcttctcccctcccctcccctcccctcccctcccctcccctcccctctcctcccctctcctctctcctctctcgtctctcctctcctctttcttttcttttttttgagacaggatctcactctgtcacctagactgagtgcagtgaagtgattatagccccctgcagcctcaaactcctgggctcaagcagttctcccacttcagcctcctgagtagctgagactatttgtgccactacatctggctaatttttaaattttttttacagatgggggtctcactgtgttgcccaggctgatcttagactcctggacacaagccatcctcctgcctcagcatcccaaaagtgctgggattacaggcataagccactgtgcctggccagctgttttcaacctatatgctgacctggatctaatcctctcataagataaaatttcactctgctgattaatcagatcattttaaaggtctcatctagctctaagagactctaataatccaatagaaagtggttacaaacaccgaaagtacaattgggaagatataataaaggctttcacagttcatatgtgatctggggtcagatgggattcaggaaactccatactttgtgtttttctaatattaaaaaaatttttatatagagatggggtcttgccatattatattgcccaggatactgttgaactcccaggctcaactgattgtccctccttggcctcttaaagtgctaggattacaggcttgagccaccatgcttggctaccccataatttgaaggagagttagttgcaattaaaaatggaggtttttttttcttttctctttgagacggagttttgctctgtcacccaggctagactacaatggcatgatctcagcttacagcaacttctgcctcccgcattgaagcgattctcctgtctcagccttcttagtagctggaattacaggcgttcgccaacacgcccggctaactttgtatttttagtagagacagggtttcaccatgttggccaggctggtctcgaactcctgacctcaggtgatccacccacctcagcctccccaagtgctgggattacaggcatgagccaccgtacccagtcctggagtttgttcttaacagaatatcaaatcttgagaagttgactataaaagaaaattctaaaattaaaaattctattctctgtataatacatagaaggtagatttttgaggtatgacatttaagatgtgaggtgcctctaaaatgtacacatacatgcttgtgtactccacgtaattgtgcctcaaggaggtagggtgaggctttctgtctttcctgaaacatgttactcttgttcagtgcttggaaaaaggatgtggttagatggagtactggcttgatacaattctctgtcttgcccagggttgagggtggtgtcaatgaaaattctcaatttgaatgccatgtaataggctccttattaatcctgactacagtataaaaaacaggctgggcttcatggctcacacctgtaatcccagtgctttggttggccgaggcaggagggtcactggaggccaggatttcaaggcttcagtgagctatatgattatgccactgcactccatcctgggtgacagagcaaaaccctgtctcaaaaaccaaccaaccaaccaacccgcaaaaccaaaacagatctctccaagcttcggcagatttgagtaattatgtgatctcttcttgactgaacaagtcacttgtcagatgaatatctggttcccactatctagggacagaaggttcccactaacattgatttcaggtaatgcataacaaataaatactaagttttttgacatctttccacaacatgtttatattacgtgtgtgtgtgtatgtatgtgtgtgtgtatgtgtgtatatatatatatatgtatatatatatacacacacacgtacatacatatatatatgtgtgtatatatatatattttttgggacagagtcttgctctatcgctcaggctggagtgcagtggcgcgatctcgactcacgacaacctctacctcccaggttcaagtgattctcctgcctcagcctcctgagtagctggaattacaggcacgtgccaccatgcctggctaatttttgtatttttttttttttttaagtacagaaggggtttcaccacgttggtcaggctggtctcaaactcctgacctcaggtgatccgcccacctcggcctcccaaagtgataggattacaggtgtgagccaccatgcctggcctttttttaaagagatggagtctggctgtgttggcctggttggtcttgaactcctggcctcaagcagtcctcctgccttggcctcctaaagtgctaggattacaggcatgagccattgcacccagtccaatgtttcctagtttttcttatgcaaacttttaaattcttctcagtatatatgtctaaaatcttctgttacaaaaaaatactgaagctgctgcacacggcggctcatgcctataatcccagcactttgggcggcccaggcgggtggatcacttgaggtcaggagtttgagaccagcctggccaccatggtgaaaacccatctctactaaaaatacaaaaagtagccgggtgtcatggcaggtgcctgtattcccagctactcgggaggctgaggtgggagaactgcttgaacccaggaggcggaggttgcagtgagctgagatcactccactgcactccagtctgggtgacagagtgagactttgtctcaaaaaagaaatggaagcaatgtatatttattaaaatatgtatatacatatacagaaatgagctaaaagtagctatattattattaaaattgtatgcaataatgattgcatagcatgttggtatgaatatgaccataatttgacgcaagttgacacatttttttttctaatattctgtattacaactaatctgcatggattgtttttctgcatgtaatctctgcttacttggtttaactttttggtcgagtcctggaagtggaattggtgaattaaaaatttagatataaactcccaaattgagccaggcgtggtgtcatgcacctgtagtcctagctgctaaggtgggaagatcacttatgcccagcaattgcagtgggctatgattgagccattgcactccagccttggtaatgcagtgagaaacataaaagtttctccctccctccctcccttctgacagagagtctcactctgtcgcccaggctggagtgtagtgtcaccactgcaacctccgcctcccaggttcacgccattctcccacctcagcctcctgagtagttgggactacaggcacctgccaccacacccggctaattttttgtttttgtatttttagtagagatggggtttcaccgtgttagccaggatggtcttgatctcctgacctcgtgatctgcccgccttggcctcccaaagtgctgtgatgataggcgtgagcaaccacacccggcagtgagaaactgtttctaaaaaaaattttttttaacgtagaaatcttttcctttttttgagatggagttttgctcttgtcgcccaggctggagtgcagtggcgtgatcttggcgcactgcaacctctgcctcctgggttcaagcgattctcctgcctcagcctcccaagtagctgggattacaggtgcctgccaccacaccccgctaactttttgtatttgtttactagagatagggtttcactatgttggccaggctggtctcgaacttctgacctcaggctatttcttcccccagggcctcccaaagtgctgagaatacaggtgtgagccactgcgcctggccatagaaatcttttcatatgtttgtagatcattcttctttgagtattctctattttttaccttcacccgttttactgagtttcttattggtttataagaattttttttgctgggtgcagtggctcacacctgtaatcccagccctttttggggccgaggcaggcggatcacctgaggtcaggagttcgagaccagcctggccaacatggtgaaacccccgtctctactacaaatacaaaaattagctgggcatggtggtgcacgcctgtaatcccagctatttggaagactgaggcatgtggatcacttgaacccgggaggtggaggttgcagtgagctgagatcgcaccattgcactccagcctgggtgacaagagtgaaactctgtttcaaaaaaacaaaacaaaacaaaacaaaactctttgcatattgaaggaacttactagcaagccttttgacatagactttgtaaatgtttttcttttgatgattatatatatggttagtttggctgtgtacaagttttttttgtttgtttgtttgtttttttatttttttttttttgagacggagtcttactctgtcgcccaggctggagtgcagtggcacaatctcggctcacggcaacctccgcctcctgtgttcaagcgattctcctgcctcagcctcccgagtagttgggattacaggcgcccgccaccatgcccagctaatttttgtatttttagtagagacggggttttactatgttggtgaggctggtctcgaacctcctgacctcagttgatctacctgccttggcctcccaaagtgctgggattacagacttgagccactgcacctggccgcatatatatattttatttttttatttaaaaaaatgtttctgagacaggatctcactatgttgctgaggctggagttcagtggtgtgatcatggcccaccgcagccttggcctcctgggcttaggtgatcctcccatctcagcctcccaagtagctaggaccacaggcaccatcgtgcttggctaatgtttagtatttttttgtagagtcgagatttttgccatgttgcccaggtagtctcgaacttaggagttcaaaacgatttgcctgccttggcctcttcaagtgctgagattacaggcttgagtcacctcacatggctgcaaagcgattttttttgagacacatttagttttttcggtgatgtcagtaattttacaattaaagaaaaagttatctgaacaaagggagagtgcccttaaattgctaagagggagcattgctttgtttttttctagtttcgttgtgtcttacagtgttcaaacactgtactggaagtaaataattaagtttaaaataattttcttctccagtgtttgattatccatttctttttgttccaatttctgtatctgaaaaacaatattggcttcaaaaacgaacaaaaaaaaatttaacttcccccagattgcagatttaccatgtaaatgtgtttccaccctgttttcaagctaatgtgacaaatttgctacattataaagaacagaaacctgtgtacagattttggggatagcacacataaaatagtccaaggacattatcaactcaggtgcagaagttcttgctgaagttctattaacaattgtgtttaaaaacaccagatgggagcagatttaaagagggagattctaatggaaggttagttgggatttgtagggaagagagagaaggattttaattgaaaagatactagaccgtattcttacctttatagcgttgtcttcttttctttcttttctttttttttgagtcatattttcgttcttgtcacccaggctagagtgcagtggtgtgatctcggctcactgcaacctcagcctcccgagtagctggaattacaggcccctgccaccatgcccagctcatttttgtattttcagtagagatggggttttgccatgttggccaggctggtctcgaactcctgacttcaagtgagctactggccttggtcttctcaaaggttgggattacaggtgtgagccacctcgcctggcctatagtagtgtttttttttcttttcttttctttttttcttgagacggagtcttgctatgttgtccaggctggagtgcagtggcacaatcttggcttactgcaacctctgcctccctggttcaagcaattctgctgtctcagtgagtagctgagattacaggtgcgaaccaccacatccgggtaatgtttgtatttttagtggagacggggtttcgccatgctggccaggctgatctctaactcctgatgtcaggtgctccgcctgcctcagcctctgaaagtgctgggattgcaggcgtgaactactgtgcccagcctagtagtattttctatccaagttttggatgtaattctcttgggatttttttcctaatttgtacagctaccactgtactgttcatgactgtatccatgggaacataagtaggatgacataagtttataacttgttgctaggcagatctagcttgtaatgtattaagattttcccattaaaaagcatttggatggttttcttttgtgcggtgaaggtaactaaacagcgtaatttggaattaaaactgtgaagttgtataaattccttctaggagaaccaactactctttgttttctttctttcttttttttttttttttttgagacaagatctctttttgtcacccaggctggactacagtgacatgatcaggtttcactgcagcctggacctcctggacacaaatgatcctcctacctcagccttctcctcccctttaccagctcctccccttcccttccccagctctccccctccagtagctgggaatacatgtatgcatcagcatgtctggctaattaatttattttttaatttttatttatttatttatttatttatttatttatttatttatttatttatttattgagatggagtctcgctctgttgtccaggctggagtgcaatggcgtgatcttggctctttgtatcttcctcctcctgggttcaagagattctcctgcctcagcctccctagtagctgggattacaggcacctgccattatgcctggctgatttttgtagttttgtggagatgcagtttcaccatgttggccgggctggtcttgaactcccagcctcagaagatctgcccacctcagcctcccaaagtgctggggttacaggtgtgacactgagctcagcctattcattcattcattcattcattcattcattcatgagacggagtctcgctctgtccccaggctggagtgcaatggcatgacctcggctcactgcaacctccgcctcctgggttcaagtgattctctgcctcagcctcatgagcagctgggattacaggcatctgccaccacacccggctaattttgtgtttttagtagagatggcgtttcaccatgttagtcaggctggtcttgaattcccaacctcaggtgatccgcctgcctcagcttcccagagtgctgggatgacaggcgtgagccgccacacccagccatatatatatgtattttttatttgagtttgcgttttgccgtgttgcccaggctggtcttgaactccggaatttcagatcgcccacctcagcctcctaaagtgctgggagccgctgtgcccagcctagtcatgtttttaattaattgaatgtctgaaatggaagataatgagttaaaataattgtgtcttaagcctgtcctcttcagctaaaacagtcagtatttagatatgtatgaacgagatgtgaacacttgatccatcctaaagtacatagcagatttcaagatgatgacaggtatcttgggtagttcttccgactctcaaagacttggtggactaaccaagaaaacctcatggagatcgagacacctgtcttgtattttggttgcaattttttaaaattaatttttaaaaaatgtaatattagtgtaaaataactaaatttcaaaaaagtttagaatgagatgtaattgaggtcacatagctcttttctgcagaggctatcacacttaacaccttatctgattgtaatttaaagaattttttgaggctggacacgttggctcacgcctgtaattccagcattttgggagactgaggtaggagggacacttgagcccagcctgggcaacatagtgaaaccccgtcttacagaaaattaaaaaattagctggctgtcgtagtgtgcacctctggttccaggtactttggagtctgaagtgggaggatcacttgagccagggaggttgaggctgcagtgaactgccattgcactccagcctgggtgacagagcaagatccctgtctcagaagaaaaacagaaaagaggctgggtgtggtggctcacgcctgtaatcccagcactttgggaggctgaggcaggtggatcacgaggtcaggagatcgagaccgtcctggccaacatgttgaaaccccatctctactaaaaatacaaaaaaaattagctgggcttggtggcgcgtgcctgtggtcccagctacttggaaggctgaggcaagagaattgcttgaacccggaaggtggaggttgcagtgacccgaaattgcaccactgcactccagccttgcggcagagtgagactcggccttaaaaaaaaagaaaaccagaaaagaattatgtaagcagttattcaataataaataatatttatgcagctgggcacagtggttcacacctgtagtcctagcacttttggaggctgaggcgggtggatcacttgagcccaggagttcgggaccaacctgggcaacatggcaaaaccccatctctacaaaaagtacaaaaattagccggttatggtggtgttctcctttagtcccagctattcaggaagctgaggtgggcggatcacttgtgcccaggaggttgaggctgcagtgagccaagatgtcgccactgcactccagtcccaacaacagagtgagaccctgtctcaattaaaaaaaaaataataatatttatgccgtttttttgtaccagctactatgataggtgctttataggacaatttggggaagtaattgctgttaactccattttactcatataaggaaagtgacgcttgcacaaggtttaatatttcttgcccactaacatgtatgcttcaagaaagcaggggctatgtgttacttctgtctagccccctcctgtatctagcatagtttctttggggtttgggtagtgtgtcaaatacagtggaaaggctggttttacaaagatgattgttgtatcttcatttattacctttgaacttgtagcttcatagggaaatcatgggaatttgagcagcactgaatctgcatgtattaaaaaaacttgcatcatttctggatttcatgtggtgaatatttgatagtacctctcgtgatttgataaggtccattatttggggacaagggtggttaacatagggattgatggaattgtgactccattctgttgtggcgtgtttagtttttacctctttccctttactcctcgtgccccagctgcgtctgtgtccattgtcctttcagtttcttactctaattgaaagaatacataggtaaagaaggaatctgatagaaggaataaacttctttgacggtattaacaagtgtctgatcttgattagtgtaagttgtattcagtgcctcatgtttcttacctttgaattgtagaaaataaaattttagatctggttaagattcttgagattatttggcaggaggaaattgaagcgcagttcagttccatagaatgttgttgaatgcgtttcttcatttgttaagagtgataatatttgtctcatagggttgatacaaggaggaagagatactctttataaaaaagtcttaggccgatttgatgataatactaatagttaaacttgttcagaagttaatctgggctgggcatggtggctcacacctgtaatttcagcactttgggaggcagaggtgggaaggatcgcttgagcccagaaattccagaccagcctgggcaacaaagtgagacctcgtctctataaaaattataaaaataagccgggtatggtggcacatgcctatggtcccaggtactcgggatgctgagatggaaggatcacatgagcccaggaagtcgaggctgtggtgagctatgatcattgccactgcactccagcctaggtgacagagtgagaccctgtctattaaaaaaagttagtctgtgttagcatagtatcggcagaaaagtattctgacacagtataggagggatcagggtatgggggaatgagtcaggaaggccattttaaagattttacagtgtcctaaacttgatagtgaaggctaagcattagaaatggaagagattggctgggcgcagtggctcacgcctgtaatccctgcactttgggaggccgaggcgggcagatcacgaggtcaggagatcaagaccatcctggctaacacggtgaaaccctgtctctactaaaaacacaaaaaattagccgggcgtggtggcgggtgcctgtagtcccagctacttggcaggctgaggcaggagaatggcgtgaacccgggaggcggagcttgcacagtgagcccagatcatgccactgcactccagcctgggcgacagagcgagactccgtctcaaaaaaaagaggaatggaagagattagaaaagatgtgaacaaaccttatagagcttccaggaaaggaagaaaggtaaaaacattgagatttggaatgttgagtaatgggatagtataaacagtatagcagtatagagatgtcactaatgttttagaaactgaaataatagattaatgcatggtaattaccttgccagaactgaaaagcggtggtagtgatgctggaggaagcagattgctgctgcagaactgcagcaaggcctaggaggtggaggcaccaggtatcttcagaggcccaggtgtggtgtggttggccctaagctgatgggctgactgaaagtctccaggaattcttcctgtctctagattatgcttcattccagcagtccaggaattagactttccctagcctagcacaagacaagtttacttttggtagagtttgaaccagagctgtaccctagacttgaaatggggaggacgggtggaaactatctggacgtggtgggggagacgtatctatgaagtgaaagtttgtatattgaatggtcattccagaattcttaatagcctggcttatactctccagcaaattagaaggttcttctttgggagaaaactggcccagatgctaacaattgagtgttaccctgtattccagttattaccgcctaacaactgttgctgttactattgtctttaaacaacaacaatcgttttattatctcacactttctggtgatgaggatttaggaagacatcagttgggcagctctggcttgggtttctctgacttaagttgtgttcacatggtggctggagctgaacagtagggtgctgaagtggccttggctggccagacagctttcttcctggtgtctcagcatgggctgatttgtgctcctcacaacattatggcctctgactgcttacaagaaagtgcaggcttccaaagcaagtatcgcaagaaaactgactattaactgattcacttttcatgacccagcctcggaagtcacataggctcctttccgatgtagtcacaagtctagtcagcttcaagggcagggaacatagattccatctcttggtaggagtacagaagtggaattgcagtcagagtgtaaggggtccctgtgggatgacatgagaaacattctgtgaccacctttggaaaacacaatctaccacattttctcatttggtcacaataattcacattcctccttcttgtcacttgtgctcacaccctctcccatcacatcgctcccccttcctgctatggcattaacttcaagttcagcatcttgtcacctgaatcaagcccagttgtggccacccaaagctcctcaggtgtggttcctctagagctgaactcatgtgacgtcaagagaaggaatctgttgcttcctctgacttaaaatggcaggacaagcttaggataattgctgtagacacatctgcccagaaaagaggaaacaggaggcacagtagtttctcatccattgccattctgaaattcagcagggcacacgttaccaattccttgatttggtctcagttctggtgcctgggaatgattgtttcaggctctggtttctgctgagaattttgttttgtcttctgagttacccttttccctaagaaatggctgatttttatagctgagtagttttcttagcctttgtgctttcggtagttttggaggaacaaaaaaaccttcccctcattttgtactgtttttgtctctttcagtccaaactggtataattcctttgaaaattttgtgggctctctctgtgtcaatttgtaacctactacattagacaggaaccacacttagcctgtttgtggtaggtccttcatttccttgggctccttgtgtgtcaccagccttagtattcttagaagccctgttgtttgatggagaggatcttaaaatccttagaaggctcttggtctcttggaaaggacagtgcagaaccttcttagatctttttgaggttttaagaaagtattacagtcacagtctgggtttgttctttaccactgagaattttgagaattgtttctttttttaaaattctgcctggaaatatccttaggtagatcatggagtttattaggtgcatttcctgttttccacatttctaaaggccacattttccactacttagacaacaggggacccttttcctgtaatgtacaatagtagttttcatagtttctattaagcttttcctgatagtttccttgttgaggcccttcaggcttttgctgatagcctcttaaaggccttgcaatttccacctgccacccagccccaaagccagtagcacagttctgggtttttgttgcagcatctcacttccaggtgccaaaatctgttccttagtcttgctgcctgaaaaatgacccccaaaagttagtgacttaaaataattccgtgatttctgtaggtcaggaatttaggaagagcttgattgggcaattgtggctcaggttcttgctttggctgcagtcagatggtagagctgaagagtagtgcacaggcaaggcagtgtgcacagctggagagggccgagctgagccgcctccacaaggtctctgtgtgaatttgtttgtgctgcttcttcagggcactcagactgcccacatagctttgtgtccaaatgtatgtcctgtgggaggatgagcagaatctgtattaccttttatgatgacttagtcttggaagttacatcacatcatttctgctctagtcaacaacttgcctggggttctaggggaggaaaacagacctcatatcttagtgtcagttggccacactgtaagaaggtgatatggggtgggagataatgtgatcagctctagaaaaatgtaatccaccatagctcttagtgaaacagttacatccctgtctgatcaccttgcaggggagtcttgccattaataagcaccagctgtgtatgtgacattaaaacttactttttagtacttccttcttaactgtgacttaacagtcaaggattatcaggcacatgaagaaaaagccataacagtctaacacagacagataaaaagaaaccaagtgaagaaataggaaatacaggttgcataagaaaagctcaaatttgaaaaaacaaaaaagcttgaagagctaagagaaaatgcatgacataaaagcaagaaggtataaagtaggggtccattcagagaacaagaaagagctcttggaaaataggattgcaggacaaattttcaataggaaaccaaggaaatcttccagaaagtagtaggcaaagacagacaaaaagagaaagacaatgcctgattggcttcttgactgaaacatatttaggtgggaagaggaagtgtggaaatgtgaataaggactgtatactaatgataatgaattaatattaatttttgcttaagtgtgataatagcactgtggttatagaggagaatgcccttaggcttagaagatgcatactaaaggaactgtcatgatatttgcatttttcagatggttgtgtgcacacacgtgcgctcacacacagtgggagagggagggagaagggagagcggttatgtacaagagagacaactaaagcaattatgatataatattagtaattgatgatgaatacaaaaacaaaacagaagggaatactttagagttaatggattggttcaggagctccaacatctgcactgttagatgttctagagagagaaaagataattgagaggaaacaatattaaatcaacacattaaaaatgttcagaagtgaaaatcacaaatctccacattgagcagacccactgagtgcccagcgcagggaataaaagaaaaaatagattggtacatcacactgagatttcagaacactgagaatagagaagatctcaaaatcctccagtggaagcaagtcaagttacagcagtggactgagaatctgtatgacactagaatctaggtgacagtggagcagtgtcctcagaattctaggagcatacccatctaggatttttttttcttcttttttgagatggagtctcgctctttcgctgggctggaatgcggtggtgtgatctcggctcactgcaccctccgcctcctgggttcaaccagttctcctgcctcagcctcccaagtagctggggttacaggtgtggaccaccatgcttggctaattttttgtatttttagtagagacggggtttccccaccatgctggccaggctggtcttgaactcctgacctcatgatctggccaccccagcctcccaaagtgctgggattacaggcgtgagccactgcacctggcccaatttaggattctatgccaaactgtagtatgaacataaagacatctttatttttatttatttattttatttatttttgagacggagtctccatctgtcgccctggctggggcccagtggcaagatctccactcattgcagcctccgcctcccggattcagggagttatcctgcctcagcctcctaagtagttgggactacagacgcgtgccaccacacctggttaatttttgtatttttagtagagacggagttttgccatgttgaccaggctgatctcaaacttctgacctcaagtgagccgcctaccttgtgctcccaaagtgctgagatcacaggcatataccaccatgctcggcctattatttttaatttgatggtcatattattccagatttggccaatgggatttccttcaagctgactcctgtgtccttttgacaaatatctataatcctttatttatttttatttttttgagacagagtcctgttctgtcacccaagctggaatgtagtggcgtgatctcgcctcactgcaacccccgcctcccgggttcagacaattctcctgcctcagcctttggagtagctgagatcacaggcatgcgccaccacacctggctaatttttgtatttttagtagagacggggtttcaccatgtcggcgaggctggtcttgaactcttgatctcaggtgatctgcctgccttggcctcccgaagtgctgggattacaggcatgagccattgcacctagccctctataatcctttaaatgcttgtttatggtatcttagaatatttcaaatttatcttgtatgttctctgcctcatcctggagtcaactgtttgtctaaggaggagccattctcttgaagtggagaatagtattatagaaaccaatatcttggcactagctgtatttattgctgccaggatattgttgttttcagccctcttagtgggcagaacaagtagatctatgtgtatttatttattagacatatttattgtctatatctctgcctacacatatatataaccatgaattttaccacaaatgccaccattttgatccaacatcataggattcattttagcccttttcctttccttatttgtagctctcgtctctgacagtgagaatcttggttctcatccttaatatagttactcatttgcttaatctccctgaaagcttggcccagacatggaatccagcaaaggataaggtgaagggaattcttaaagagaaatcttgggataatagctgtgtaggcattcaccagttagtccagattggtgagtgaagacagggctccaaaggggtgttgtcaagaaataaacaaccaatagatagcctgatgtgttgagacttacacatgtagtagaagtttggaggtgaattagtgatacatatacagaaaaccaaacaagcaaaaaaaacaaaaaaaaaatagaattattaattccaggtaaaaaaatcacacataatcacaccactgaactctggcctgggtgacagagtgagaccctgtctcttaacaaacataaattaaaaatcaggtaaaacaaattgtacaagaatggacttacaacaacagaatgcaacaggattcagctatgaatagtatttactagtcataaactacgagagtgccataacactgaacttagggagcaatttagggaataaactgagaaaaaaagtacacaggggccttaggacctaagcagctagtgtgatatcacttgtggatgtttagtatgcattttgggtaccagccccttttgaacactgtctttgaggggaaattgtccactccacagtagaagctattaatatgttttcccatcctctcttgtagtttgtcatagatgtgtgacttctattccatgcaccagggcaagactaggattaggaagcaagtgatgtgaagtagacaagcatggctgccaggtttcagaggcagcgttttctagcggtggtgtccactatgcactgccaagtgtccttgtgtttaacacctgcagcagttaagacctccactgaagcagttctgtggggtaattctggtgttgtcctagttgcatggcttgtaaatctggtttgatgaccttcctgtagagccatttagttgcttatattagctagaatgggctttgtttactgtaaaaaatctggttgacgaaattggcattaggaatgatcctcaagaaaatgaattggttatctaacttggttgtgtatgaaggcagtgaagaaaggtgagagcttaaagaatcatagtggccttgggccgggcgcggtggctcacacctgtaatcccagcactttgggaggccgagatgggcggatcacgaggtcaggagatgagaccatcctggctaacatggtgaaaccccgtctctactaaaaatacaaaaagttagccgggtgaggtggcgggcacctgtagtcccagctactcaggaggctgaggcaggagaatggtgtgaacctgggaggtgcagcttgcagggagccgagatcgcaccactgcactccagcctgggcgacagagcgagactccaccgcaaaaaaaaaaaaaaaaagaatcatagtggccatgggcatggtggctggtgcccataatcctggcactttgggaggctgaggtgggagaatcacttgaggtcaggaattagaggcctgcagtgagtgccactgcacttcagcctgagggacagagcacagagcaagatcctgcttcaataaatggatggatgggtgggtgggtgggtgggtggatggaggaatcatagtgatcagcagtgcttaatgactgagattagtctattctgaagtatgttaataaagcttgaaggatcagaggaagagagtaggaaaaaagcacacacattctacaaacctcgccacatccactcagttaaaagacagaacaggattcccttggatgttgggaaagggaagtcagacgtgaaagttgtagacaggattaagccacttaattttcctattaaatggactctagagagtaagttcatgcttctcattttactgatggagaagcagtaccacatacttggtgaaattcctgtgtctgcaaaacattggttattctgcaattgttatatataaagggataaacattgaagttattggtctcttccttctcattggtattgtgggtgttctttaccaactgagttaggaactgacttgagatattttaaacttacgggacttgatttagagcacttactcttagatgttaaatatttggtttgctctttattgaataacttaattatcttattactaataattcctgtattagacaatgagacttagactcataatagaatacaggtatcttaatgagaatgttctcatttaaaacactaactcctaattcactagcagctaataaaactaacattgttgcacagtacattgttgactagttagaagaatttgacagtatgtttggtgctgagaccagctcggtcggggagaccctaacccagcggcgctagaggaattaaagacacacacacacaaatatagaggtgtgaagtgggaaatcaggggtctcacagccttcagagctgagtattgctattaataaagggtgtagaatttgaaaataggccaggcgtggtggcccacgcctgtaatcccagcactttaggaggccgaggaaggcggatcatgaggtcaggaggttgagatgagcctgaccaacacagtgaaaccccgtctctactaaaaatacaaaaattagctgggcgtggtggcgggtgcctgtaatcccagctgctcaggaggttgaggcaggagaattgcttgaacctggaaggcagaggttgcagtgagccgagattgcgccactgcactctagcctgggcaacagagtgagactccatctcaaaaaaaaaaaagaaaaagaaaaaagaatttgaaaatagcttgagagactagagaagaagtgaactgatttattttatatttatgtatcttattttttggcttgttgaccagaagtgaattgatatgaataagcacacttgcaaaataaatgggttatttatttatttatagagacagggtcttgctttgtttcccaggctagagtacagtggcaccatcatagctcactactgctgctggcaacttctgggctcaacgggtcctcctgtcttgacctcccaaagtgctgggattataggcatgagccgtcatgcctggccccctaattatttagatagccctgtagacctgatttcttgtggctgaaggtctctcaaattgattctcagtaggcttcataaataaaagggaacttacactggaggatctttatgctgaattggcttagaataagtagaaattgctaggaatgttttatttttgtttatttaatttgctaaatctgctttagatatgagccttgtaactggatttcttaaaagtgtccttatgattgaatctatttgtggtgtttggattgattattttaagttcctactatgtaccagacgtttgctacttgttttaacttgctgtttaatctctttgaagaaggaactgtttcctccatttttatagaagagaaaattgaaacttaaagagattagagaactctccttcagtctaggcagagctgggattccatttcaggactgttatgctacaccaaataaatgcttgctgcgttaaagaatgacttaacagtgaacaccttaagtcttcattgcccagttacgtgaatggaagaaaggctgagcagtgaattacaaacactctctcctctagtcttctggcagtgttcctttacctaattctgtgtcctcaaacgccctgttttctttaggtgattatattatttgtttcttttaagcttgcctgtctgcttgttcttctgaacagttcccttcaaatgttacaccatccacccacatctgtatttcagtattttattgtgtcctttcattgagactctaatttgggtgaaaattctccaaactacatttctttttagcatattctatttttgtcacctagaatcagcctcccagctgactttttcccatagatacgtaacaaccacctgctttaacattttctatcttccacttaacaaaaatattactgttgataaataatgaatacttagcatgtataactgtgcaaataaaatgggaggaatgtgtatcgggaagatttgaggggagtgtggataaaaaactgtttgaaaataccagctgttgaattttatagtgttactctttttatttttattttttagttttattattactattttttgagatggagtttcgctttgtcgccaggctggagtgcagtgacgtgatcttggctcactgcaacctctatctcctgggttcaagcgattctcctgcctcagcctcccgagtagctggaactagaggcgcgcgccagccaatttttgtatttttagtagagacagggtttcaccatgttggcaaggatgatctcgatctcttgacctcatgatcttcctgcctcggcctcccaaagtgctgggattacaggcgtgagctactgcacccagcctattattattttttaattgagacttgtcttactttcacccaggctggagtgtagtggtgcaatcttgcctcactggagcctccgcctcctgggctcaatcgatcctcccacctcagcctcctgagtagctgggaccacaggcactcgctaccgtgcccagctaattttttctatttttggtagagacagggttttgccacgttgtccaggctggcctcggcttcccaaagcgttgggattacaggcatgagccaccacgtgcagcctatagtgttattctttagtagttcctaaaaggcttgtgttagatgtttatagctgatagttgtggtttgaatctgtgtccccagccaaatcttgtgtcgaattgtcatccccagtgttggaggtgggggcccatgattggatcatgggggtggatatcccccttggtgctattttcatgatagtgagtgagctctcgggcgatcgggtcgtctaaaagtgtgtagcacctccctcttgtctctcttgctcctcctctggccatgttatatgtgcttgctttccctttgccttccaccatgattataagtttactgaggcctccctagaagctgagcagatgccagcatcatgcttcctgtacagcctgcagaaccttgagccattgaaacctcttctctttataaattacctagtctcatctcaggtatttccttctttctttctttctttctttctttctttctttctttctttctttctttctttctttctttcttttttttttttttttttttgagacggagtctggctctgtcgcccaggccggagtgcagtggtgcgatctccactcactgcaagctctgcctcccgggttcacgccattctcctgcctcagcctcccgagtagctgggactacaggtgcctgccaccacgcctggctaattttttgtatttttagtagagacagggtttcaccgtgttagccaggatggtttcgaactcctgacctcaggtgatctgcccgcctcagcctcccaaagtgtcgggattacaggtctgagccattgcgcccggccaggtatttttttatagcagtgtgagaacagactaatacaatagccatcatgtaaaatacagtttccattttgagccaggcacttgggtaaaaatgaagagtaggtaaaagacaagatgtagttctaatttgagcttgtcatttagtatttgagtaatgccgcataatggctgtgggtttccgatgacacacaccttttcatgatgtgggtggcctagggagtagtgtgtttgttggaaccacagttctctgcagagggaatatgattaagtctgatctttgtaatttagaattaatgaggccaggcgcactagctgacacctgtaataccagcactttgagaggcgaagatggggaggatcacttgagcctgagtttgagaccagcctgggcaagatagtgagaacctgtctctacaagaaaataaagaaaaaaatttttaaaaaaagaaaaaaaatatagaattggtatcttggccacacctctttccctgtggttgagttttttttttttttttttttcctgttcttttcctttttttttgagacaagatctcttcgtcacctaggctggagtgcagtgacatgatcaaggcttgctgcagtgtcagtctcctgggcttaaaggatcctcctgtctcagtctcccaagtagctgggactggaggtaggtgacactagcctggctcactttaaaaacattttttgtagagataaggtcttgccatgttgcccagggtggtctcaaactcctggcctcaagccatcctccctcctcagcctcccaaagtgctggggtctctggcattcaccaccgcggacaacctttttttttttttttttttttttttaagctaaattttgttgaatatttggataggcaatacaggcatatggtacaaaattaaaagatgcaaaagggttatgcacaagagaagtacatttcttaggcattcctggccttccattttcccttcctggaggcagttttctgatttattttctacaaggattctgtttaaatactggagaatatctgacctgttgtactttactttagaatggcaggaagctgaatgactcatgggcatttttccctttgtgaagctcattgacattccttcctctcaataccttaactatggcatgttttataatttgcttttgtttttgctttatcacagtattttcctatgttttttatagtcttaatttttaagcactgctttaggtatctattaatagttcagaaagttgcgaagattacaagctcatatttgtgaaagtgtctggcacataataggtgatcaataaatatttccttctagcttgtctgtcccctatctcccactggttgtatgtatgaaacaaaaaaatgaaggagaaggctgagcatagtggctcatacctgtaatcctagcactttgggaggctgaggcgagcgaattgcctgaggtcaggagttaaagaccagcctggccaacatggtgaaaccccgtctctactaaaaatacaaaaattagccgggtgtggtcacaggcgtctgtaatcccagctactcaggaggctgaggcaagagaattccttgaacctgggaggtggaggttgcggtcagtcgagatcgcgccactgcactccagcctgggcaacagagtgagactttttgtcacacacacacacacacacacacacacacacacacacgtgaaataaacctatgaaccaactaatgcagtggattccaaaattaagattaagcttgtgtaagttgtaatgtttcttgatgtacccatttatttgagtggaaacagattcttttcattctttgaaatcactttgctgagatttttttattttttttattttttttttggagacagagtctcgctgtgtcgcccagactggagtgcagtggtgtgatctaggctcactgcaacctccacctcccgggttcaagcgattctcctgcctcagcctcctgagtagctaggattataggcatgtgccaccacactcagctaatttttgtatttcagtagaggtagggtttcaccatgtaggccaggctggtctcaaactcctgacctcaagcgatccgcctgctcagcctccctgagtattgggattataggtgtgagccacggtgtcccgccaagctgagacatttttaagaaaatgtttctgtttttttgtttatttgtttgttttgagatggagtctcactctgtcacccaggctggagtgcagtggtgccatcactgcaacctctgcctcctgggttcaagcaattctcctgttccagcctcctaggtaactgggactgcaggcttgccaccatatacctggctgattttttgtatttttagtagagatggggttttaccatgttggccaggctggtcttgaacttctgactcaagcgatctacccacctcagcctcccaaagtgctgggattactcccacagcacctgctcagaaaaggtttcttttcttttctttttttttttgagatcaggtctcactctgtcgcccagggtgtagtgcagtcgcgcaatctcagctcactgcaacctccgccttccaggttcaggtgattctcttgcctcagcctcccaagcaggtgggatttcaggcatacaccaccatgcatggctcatttttgtatttttagtagagaggggtttcaccatgttggccaggatggtcgcgaactcctgacctcatgtgatccacccgcatcagcctcccaaagtgctgggattataagcgtgaatcactgcacctggctagaaacatcttctaaagcctaatcttttttttttttccttatataatttaggttgactatgtaaacccaaaacacatagggtagaaactcgtgaaaaatatttttgaggatatctttgcaaagtgttgtgcctcacggtgctggatatggatgtgtgcttagtgtcagtgcatagatttaggatttcccacctgtatgtatgcttttggtgagtccttttaggcgatatgtcctcatgttcaaggagtaatggcatactggttcatttaaacccatgttttaatcctaatttaagaccgatttacttcttcttggagctaatttcttaacttttctgatgatgtttttgttgcttaagttaagactaatataacacagaagtcttactcatcctttttgatattagagattttggtttattaatctagtggaattttaaatatcattttacatgtttactctcaagatctgatgattgactgactgggtgcagtggatcacacctgtaatctcagcactttgggaggccaaggcgggcagatcacttgaggtcaggagttcgagaccagcctggctaacatggtgaaaccctgtctgtagtaaaaatacaaaaattagccggacttggtggtgcgtgcctgtaatcccagctactggggagacagaggtgagagaatcacttgaaccccagaggcggaggttgcagtgagcctagatcactccattgcactccagcctgggcgacagagtgagactccgtctcaaaaaaaaaaaaaaaaaaaaagaagattgaattaagggcaaacttggaacaggccagtttcccattatattgcctctctgaaacaagtgaaagagttttctttatgaggggtgttctttttaatttaatttaattaatttttatttatttattttgagacagagtcttgctctgttgcccaggctggagtgcagtggcatgatctcggctcactgtaacctctgcctcccaggttcaggtgattctcctgcctcagcctcccaagtaattgggattacagatgcccaccgccacacccagctaatttttgtatttttagtggagacggggtttcaccatattggtgaggctggtcttgacctctgaacctcagatgatctacccacctcggcttcccaaagtgttggggttacaggtgtgagccactgtgctgggccttctttttaaaaaaggtttttctggccaggtgcggtggctttaatccatatgtgtgagaccaggcacggtggctcatgcctgtaatcccagcactttgggaggcagatcacctgaggcatgagaagtgcttgaactagggaggtaagaagttgcagtgagccaagatcacaccattgcactccaggctgggtgagagtgagactctgaaaaaaataataataaaaatggttttcttacttttatgacttgaattatggaaagtttttagaatgtgactcttttctcaggaacaggatggctacctacctaccccccatccttttcctgtatgctatggattatcagacccctcacttgggttcctcttacatcaccaaggtgtgcttgtcaatacccagaaaccaacactgatacattactaagttccacattttatttagattccaatagttttcccattaatgtccatttctgttctagaatccaatccaggttactgtatgcattgcatttaattatgatgtctccccagtttgctgtttttcacatgactagactagggttatgaatttggggaattcatatgattggagtggtgggaggtgtagtgcatgctactccatgatttattgctggtaatgttaatcgtggccaaggttgtttccctactgtatacactcaccaccttccatacttatttttttggaaacaagttagtaagtccaacctacactcaagtcggggagatttaagctccatctcctagaggggagtggggaatatttacataaattatttgaaattctcccacgaggaagctgctttttctaggaaaggtctttgcccgttattctaccgacttactggactttttatttgactttttaaaaagaagctctttagataaaatctccataaatacttagataaattactgcaattttatatttgcatatgaacaagtggagttttgttgatgcagggttgcattggccttcactatcaaaacaaatgtctcatctgatcagcatttataaatagtgaggtaccagaatcattaaggctcataaagtcttccgtttttattttggctattctggtggtgggtaacaatattaacaacaataaaaattcatcttattttactggagattcctgcaaagtggcagaataccaggacaaggaaccaattctggcacacatgtgtcaaacaagaaagctctgggaatgtaataatgtaataaagtgtggtcgagagagctctgggctggaataggcatggggtccttgacactatcacctctgccaagacacttcatgtgtatggtttccccacctttaagtaaactctatttatgaagttctttgtagctttaatagtttctagagttgcttgaatttggggtgacttcttgcaagggtaatgtgaagtagtgtcacatggacagtaacggagaggtatctgctgctgccatttatataataaatctgaatttggaggcagagaaaggaggcagaaagtttggtaaggacgttattgcaacctgaataagccacttagggcctagatcagtgtttgggaatgtgggagaagacagccatagtcaagaagcgtgaagtagttaatgttgagttatttttaggtggtttttctgttctttttactccagacactgactttcgtaataagataaataatctggtgagtcgcatgctcatggtgtgctgaggcatttagccaagcagcttatgcatgtattatctcatttaattctgtcactatgaggtagagattatctttaaccattggttccaaatgagaaagccctgtttgaaataatttttccagtgtatttaaattttgtaggtacacacctagaatttcaaactgatggtctgagttctgagcccatctgtttaattcatcctaatgggttatcttgtggatatgctgattatagtaaaacaactttaagaatgtgatatacattatgagtgatacttgtggtttgaatgggtttttttaaacaacatgaaaatttgaagatattttgcatagatttgcttttgggtaaaacttttttttttttcatatcttctgtaattaacttctttccccccttttttgagatggggtctcattctgtcacccaggctggagtgcagcttgatgtatgatcatggcttactgcagccttggactcctgggctccagcaatcctcccaccttagcctcccaagtagctggaagtacaggagtgcaacaccatgccctgtagagacggagtcttgctgtgtttcctaggctgatctctaactcctggcttcaagtggttctccctacttggcctcccacagtttgattagagatgtgaaccactgtgcccagccaaaattaactttttaatctattctaaatcaagaagaaaatagatgtgtcttttctgggactagtaatgagaaattgacagcatctggtttttggctgttgttaaagtgtgattattactatactggtatgctgataaagagattgcatggtaattttcatcctttcatctaaaaacataatattataaggatagatatttccttagtatggggtgacttgtgtagattactatctcataaattggttcagattagtttttaaaaagggcaaaattgtatattagtgatattgctcagctctttttcaaagggataaagcactgtaaagagagaatgtgggggtagaagtctaataaaatcctcacaaatctggatcagtaacagaaaagtcagttataggccaggtgccatggctcatgcttgtaatcccagcactgtgggaagctgaggcaggtggattgcttgagcccaggaattcgagaccagcctgggcagcatggtgaaaccctgtctgtactaaaaatacaaaaaattagctgggcgtgatggtgggtacctgtagtcctagctacttgggagtccaaggtgggaggattgcctcaacccaggaggcgcaggttgcagtgagtcgagattgtgccgctgcactccagcctgggcaacagggtgagaacttgtctcaaaaaagaaagaaagaaaagtcacttataattatgtgggctttaaaaaacctgactgatagtgctctgtttttagtttcaccaaaagataggtagtacttccatcctctttcatgaaactacagtatgtctattctcaatgtttcaaaaccttgtaagactcagagggaagaaatagtttctcattaagaaaaatttagtcaacagtataattatgtattaagtgcttcaggaaaagcaatgggggaaagtatttcctacagtattaggtctctcattagaggtgagcagagggagttccttcagcgcaggacgggcatttctgcaggtgaagtgggatgagacaaccggctatagcaagatgttagcatatgtagttagcttatggaaacataatttgaattggacatgagtttttgtttgtttttgaggcagagtcttgctctgttgcccaggctctattgcaatggcacgatcatggctcactgcagccttgaactcttggactcaaggagttcacccacctcagcaacccaagtagctggaactacaggtgtgagccacaatgccttgctaatttttttttttattttttgtagtgacagggtctcactttgttgcccaggctggtctcaaattcctgacctcaagcaatcctccagccttggcctctcaaagtgctgggattataggcgtgagcactgtgccctgcctatgagttgttatagactgggtgattttgtagtaggcagcagtttgttgtcatttgcatgttgtacttcatgtatggttttcccaagtcattaaatgtacatacttctgcaactttttattttttattttttctggtgaaaagatatacatatatttagaattagccagctggactcagtttagatgaccccaattttgttggcaacatccaaagcatcataatcaggagctagttgaacgtatgcctccttctctccatcaggccgaatcagggtgttgaccgggccacatcaatgtcatagagcttcttcacagcctgtttgatctggtgcctgttggctttaacatctacaatgaacacaagtgtcttgttgtcctcgctcttcttcatggcagactcagtggtcagcggcaacttgatgataatatggtggtcaagcttgtttctcctgggggcgctcttctgaggatatttgggctgcccctggagtcgcagtgttttgggccgctggaaggtgggtgatgtgtggatcttttttttttccggctgtggacgcctttcaacactgctttcttggccttcacagcctttgctttggcttcggcttgaggaggggcaggagcttccttctttgctttcggtgccatcttgtgaaaagggctctgcagcttttaatgtgtacagtttccatgatatgattgtaccagattataagattatgttggacatttgagttctttccaatttattgctgttttcagcagcacttgatgaataactttgtagataagtttttgcaaagctttatgaatattttcttttgggataaattgctagaggctcgggtaaacattgccaaactacccttcagaaagcctgaacttatttacagtacacttatggtatggtttggctctgtgtccccacgcaaatctcatcttgtagctcctataactcccacatattgtaggagggacctggtggtagataattgaatcatgaggccagatctttcctgtgcttttctcttgctagcaaatgagtctcatgagatatctaatagttttaaaaaggggattttccctgcacaagtgctcctctctgcctgctgccatccacgtaagactgagttgctcctccttgccgtccgccatgactgtgaggcttccccagctgcatggaactgttaaatccagttaaacctctttgttttgtaaattgcccagtctctggtatgtctttatcagcattgtgaaaacagactaatgcaacttctctcaacatttctagtggacaggttttctatgttcccttctaacatcctgttttgccaaacttttgcaaagaatttcatattgtcttttttcctaattcaaccttttgtaaggaactcttacaacattggtgtaaaggtatgtccttagctggtggtacagtagttagaagttttctctgggttatggtgatattgggagtaattgtgttataggataatctgggctctctgtatttcataagattgtggtgcctcaccatcagtcagactgtagcttcagggcttttttttctcttggattgcttggtggtgaaatatcaatacagccttgcccattctgattagtgtgttacattactgatagggcagtgttaagagaaataggagaaacctgagcctaaaacatttcactgtgaaattaattggtctctgaagtgttttgtctttgtttaggtttgacgatcgtatgtggcgaaattacattggtggtaaatgataagcttgttatattgataacatggaagaaaagtgtttctggtttctcttagagaaaatcgattcccagtccaaggcacctgtgagtccaagagaatgagagaaggtaagatgttattagttagaaactgactatacaattccagtttctagtgcagagttgacttcagtagcatttgattagcatctaacttccttcttgggggaatcagaaaagggacatagattaggcattagctgaactcagattactggaaagtgattgagtcagttctattttttatttttattttttgagacagtctcactccgtcacccgctggagtgcagtggtgcagtcttggctcatgtcaacctccgcctcctgggttcaagtgattctcatccctcagcctctctagtagctggaattgcaggtgtgagccaccacgcccagctgggtttggttttttttgcatttttagtagagccaggttttcaccatgttgtccaggctgttcttgaaatcttgacctcaaatcgtctacccgcctgagcctcccaaagtgctgggattacaggtatgagccaccatgcctggctttgagccagttctaagggaaattattcatttatttttgtcagcttgtaatattgcaaatcatagtatttttgaaataaccttcccatgggaatagagtttatgcccttaaagggtagagtgctattataaagagagatacaagaagagagggagtgggtggcattccagagatcaggtctacatgagttgctgcccagccttcttggttctcaaacttgtcggtctggattgctgtgtttaaggaaagggaatagaacaatatactccctttctaaaatttttcattaattggctacctaacctatgttatgcatattaatttacttaacatttatgaagtacttataatatgctagacactgaagatactatggtctgaaagatggcaaataatagaggagaaagaaaatcataattgctattatttatgaagtattaagtacaggcagttcttaagcattcgacttagtatttttcaactttaagatggtacaaaagtgatacacactcagtagaaactgtattttgaattttgatcttttcctcggctagcaatatgtggtgtaatacccttacatgagatattcaaccctttttttttgttgttttttggagacagagttttgctcttgttgcccgggctggaatgcagtggcgcaatctcactgcaacctctgcctcccgggttcaagcgattcttctgcctcagcctcccgagtagctgggattacaggcatgcaccaccatgcctgactaattctgtgtttttagtagagatagagtttctccatgttggtcaggctggtctcaaactcctgacctctggtgatccacccacctcagcctcccaaagtactgggattataggtatgagccaccacacctggcctcaacactttttttttttttttttttaaataaaataggctttgttagatggccttgcccaactacaggctaatgtaagtgttctgagcatgtttaaggtaggctaggctatgatgcccattaggttaggtgtattaagtgcatttttggattacaatattttcaatttgtgatacatttatcaggactaacactgttgtaagctgaggagcatctgtatgtaccaggtacttaatattaaggtggcctttctaattctcatagaaacccatgcaaggtaggcattatcctctccatttttctttagggttagtgaagctaagtagcttgttcgtcatcactcaataacaaagtggttaaaatgggatacaagtccaccatgggattgagtcccagatgggagttcagatgctgaccagtgttaggatctaagtgcaagtcacttaactcctcttttcaaatgtggactacaacagttcttatctcatagggcttttttggtgtgtgttatgtgacagataggtgaagtggttagcccagttactggcacgtagtaatagttaataattatattagatcatactggctcaaaagccattaatagtagttactgctggtagttgagtcttacaaagccattgttttctccacatgtctttatgcaaatcattaatgacaagagcctaaactgtgatagagaaggtgtccccagtgttatgagagtattgaagaggaatggactgctaacctggactaggagagtaagcagacttacaaagatggtgatccttgaggggtcttgaagcattattaggagttagctggtgggaaaagataaagagaaggaagtgggttagaggaaagtcatggcaaagcaaaaaggcccagaaatgtaatgactgtgtgagggatagagtcctgagggtgagacataggttagaaagataagcaggccagattatgaagggtcttgcatgccatgggttttttccctaaagacagcgggggaagcagcagaaggactttttattttggaataattttagatttacaggaaagttgtaaagatagtacaaagagtttccatataccctacacccagtttccccgttattaacatcttacattagtatggtacatttgttacaattagtgattgattgatttgtaattattacctgaagttcataatttattcttatgttcttagtttttacctaataccccttttctgttccagaatcccatcgaagataccacattacatttagttgccttgttgctttaggttcctcttggctgtgacagtttctcaagatttttcttgtttttgatgatgttttagttttaagaagtactaatcagaaattttgcaggatgtttctcaattgggatttgtctggcatttttctcattattgtactaaggttatgagtttggggtaggaagaccacagacgtagagtgccatttcatcccatccaagggtacataccatcaacatgactgatgactgctcatgttgaccagtgttgcctggcggagtactttacagtggaaacgtctgagtttgtcagaagtttcagctgtaaagtactcttccatctcctgctccgcccctttccatacaacccccttttttggaaagaggtcactatgcacagcccacactgaaggggaagggagttatgatccatatctcaggaaggacttttaacgtggaaagtgatttgatcagaattatgttccagggccaggcacggtggctcatgcccataattccagcactttgggaggggaggcaggaggatcagttgagcccaggagtttgaggctgcggtgagctatggtcatatcactgcactccatcctggacaaacagggcaagaccttgtttcttaaaaaaataaagaatgggctgggcgtagtggctcacacctgtaatcccagcactttgggaggccaaggcaggtggatcaagtgaggtcaggagttcgagaccagcctggccaacatggtgaaaccccatctctactaaaaatatgaaaactagccgggcgtggtggtgggtgcctgtaatcccagctgctcgggaggctgaaggaggagaattgcttgaacccaggagatggaggttgcagtgagctgacatggtaccactgtgctccagccttggcaacagagtgagactctgtctcaataataataataataatgataataataaaaaataatgaattgtgcttcagaaagattgctctagctagtggagaaactgaatctggggagaccgaatttagcctgcaacctttaagacaggacaagatgagaaaccatgaagttggaaactgaaggtcagtggcagcagggttggagagcgatggatttgagaaaagtcgaagagattagtggatggggctcagtgggttttgcagagtgtgtgtgctcgagtgctagtagcagatgaggggactccaagatgacttgccagccatattgctgggagttggtgactatacaagtgatagtgttaatttttttaggtaaacaagaagaaacagcttgttgttgatagtgggaagggtgaatgagagggcaataagctgtgtcaagatgctttttgagttgttcttggcttatatgcgtattctgtcttgagataaagatttagaagtcattaccataataaatgtggtttgagaaatttgcagtgttagatgttatggcataggaagagtaattaataccagatgaaaaagaggaacccagggaacactgatgtttaaaaaagtggtagagaaaacgtggggaaaggtcaacttttgttaaaatctcttattcatgtggctgtttaattcctctacatcacatcctctcttctgttcaccctggaggtgtaaaacactataccaaaggacagaacacactatacacgtttagaacatttcttctgaggatagttactgctgcggtaatgcaggtactgttgtggtgatgctaatgagaataaatcttgctaaaattaagaatcaagacagctgaagacctatggaaagcaattgaccgaacagtactacttcaggtcaggtaagcagtggcagtacaagaatgaagaatggattctttgttaccaagcaattaacaatctagttgggtatttactgggtaatacaatacaaagtaagcaatggtaattggttatgtgtatgtcagttgtggcatgatagtttctacctcggctatctgctgaagccctttctgtctgtcttctctccctgtccagctttgttcttgcctgcctttttattttttacagtccctctccttttttgcaggggggcggggcggtgctagtgggagtatacatacccctcgttaaccacctgtgatgtaagttaagatttttttttaaatgtttctgttttttaaaaacaagtgaatagagcatttattatcatggaggataaaatcctcaaagaaaaaatctgtttagcttttaaattcttcgtgaaatcgctaatctttgaggcgaaaaattttttcccgtaaatttaggagaacatgagatttgagtttttaaggactttatagcgtgcctatgtttattgtagattttaattccagagagctggtgattggaaatcatggacctatttgttccaatttaaactttcagcatttaaaaaggaagagataagagagaaccagacaggaggtatatagtttgtagaaagatacagatatttaatgtaatcccagcactttgagaggctgaagcgggcagatcacctgaagtcgggagtttgagaccagcctgaccaacatggagaaaccctgtctctactaaaaatacaaaattagccaggcgtggtggcacattcctgtaatcctatctacttgggatgctgaggcaggagaatcgcttgaacccaggaggcggaggttgcagtgagctgagatcgcgccactgcactccagcctaggcaacaagagtgaaactcggtctgaaaaaaaaaaaaaagagaaaagaaaagatacaggtattgaaataccaaagttgcttctgacttcctcattttatagagagtgaactgttgtcagttgagaattcttaagccatttaacttaaatgctaaaatacttaatgtggatatcatggggaggaaaaatgttctttacattctttggtttttgatcataatgtatggtgtctttaaaatctaggcattgtagcataatggttaacaccaccgactctgtcttctgctgttttcatacctcttccttaagcttcgactcagcttcactgctcataggtgtgatgttgggcagcttacttcatctctctgtgctttaattttctcatctataaaatggatagtcgtaagattgaaatgaactaaggcacgtcaaagtacacagtgcctagcacatagtaagcatttataactgttacagcaatagtaatcatatatactcttgccattccctttgatttctatctttttgattacccaacgtcagaagccaaaaattttggagtcataaaacgttttttggtccctaacataattaagttaaatttactcatgcgtagcatctcaggatatattgaaagtatgggtggccagtccatacatttaagaataagaattataagaatttagagacagagccttgctttgtaccccaggctggagtgcagtggtgtgacctcagctcactgcaacctctgcctcctgggttcaagcaattctccggcctcagcctcctgagtagctgggattacaggtgtgtgccaccatgcccgactaatttttatatttttagtagagacggggtttcaccatgttggacaggctggtctcaaactcttgacagcaagtgatctgcctgccttggcctctcccaaagtgctggggttacaggcatgagccacttcacccggccagaatttacctttttaaaaagctttatttattatctttttgagtcctactgatgagtaatttggagtttcatgtgtcctttttatataggtattagagtatgacaatgacatctataatgggatagaatttaaattttaaagcaaaccaaacagctgtcctatttatgagtgctaacttaaagatggtttgataacatgaaggtaacggtactatgaatgtgaatgtaatgaccctatatatacacaataaatatacacaatatatatacagttctctgtttatacttttcagcttcagttttcttgttctgaatttaagcaagaaggtagcatttaattcatagcttattgtgctactcctgttttcatacctcttccttaagcttctggtaaaattaaaacatttcaagtagagtttaggattgtagaaaacaaggcatgttgttaaaacctgtaattgtgagcgtgtcttaaaatgacaagattattatatatatatatatatttatttattttacttatttattgattgattttgagatggagtcttgctcttgtcgcccaggctggagtgcagcggtgttgtctcagttcactgcaacctctgcctcccgggttcaagcaattctagtgcctcagcctcccaagtagctgggattacaggcacctgccaccatgcctggctaatttttgtatttttagtagagatggggtttcaccatgttggccaggctggtcttgaactcctgacctcaggtgatccacccatcttggcctcccaaagtgctgggattgcaggtgtgagccaccgcacccagccctatcttataattattgatagcaagaaaagcatattcaccatttgtttcagttctcattgttttcgcttccccttctgtgtttatccatttggccattctctttcttgtgttcatctttctgttctgactcaggtcattgaggatatggttggaccctgaatggtagaaacacaactccctcttcccctcgactccacagacttaatgtgattttttagggtataggggagggggttatgagaatgtgggaacccaagcaggtgttctaatggctgtggagtaacctgtcttctccttccagttagtttctgtgttttgtttgtttgtttgttttaaagagacagggtctctccctctgtcgcccaggctggagtgcagcagggtgatcatagctcactacagccttgaactcttgggctcaagcaatcctttagcctcaccctctgaagtagctgggactacaggtgcttaccaccatatctggctaacttttaaaaactttcagagatagggtctcactgtgttgcccaggctggccttgaacttctggcctcagctgatcctcccacctcagcctcctgagtagccttgctttttaaataacagctttactacaataaaattaacaaaacacgcagttcacttatttaaaatatgcaaaattcagtggttttcggtatattcagagttgtgtaactatcaccacaaatcaaatttaaaacattttatcatcccatgaagaaatgctgtacctgttagcagtggcaccctgttatttcaaatgccctacagcctctggcaatcactaatcatctttctgtctggacggttcatgtaaataaaatcatacaataggctgtggatttttgtgcatgtgactggctgctttcacttagcatagtgtttcaagtttcatactgagcatgtgttagtgttttattttcatggcagtataaagttctgtcatatagacatactgcatttttttattcaatcggttgatgggcatttgggttgtttctaccttttagctgttgagtaatgctgctatgaaaatttatatacaaattattatgtggatatatgtttttatttctttgggctgtatacctaggagtggattttctgggttatatgataattttttttcttttttgagatggagtctcgctctgttgcccagtctggagtgcagtggtgcgatctcggctcactgcaagctccacctcctgttacgccattttcctgccttagcctcccgagtagctgggactacaggcgcccgccaccacacccagctaatttttttttgtatttttagtagagacggggtttcaccatgttagccaggatggtctccatctcctgacctcatgatccgcccgcctcggcttcccaaagtgctgggattacaggtgtgagccaccacgcccggcctctgggttatatgataatcttttgaggaatggcaccattttatattcccaacattttagccaaataatctgactaaaaacaggcaaaagagctgaatagacatttctccagggaagatactcagatggccaataaacttatccaatatgctcaacctctttattcagggaaatgcaaatcaaaaccacagtgagagactacttcacacctgctggctagaatcaaaaagtcagataataacaagtgttggtgaggatgtgtagaaattggaactctcataccctgctggtgggaatgtaaatgtaaattgctgttctgctcccaaacagttgacaagtaaaatatagcattatagagtgagaaataactcagagtttcagagtagaactgaaaatatactagaagagtattttccttagtgttggactagatgattttaaatttgaacacagacattgtatcaggtaacatcaaatcatacagtgaagggtttctcacaatgtacacaaaatagtatttgtctgcttaacactgggatttgcaaagaacagtgaaatattacagtgttacaaagcaagatcttcctctctttaaatgcctgttaacctgattttaagaatatctttattgtatacatcttattctttaaatgtaccccataactaatagtaccaattttatgttttcaacatttaagttatgatattatacatttcctttaacttgctttttctattcaaactggttgatagctgtagatctgattttgttttctatatttaattcccttgaagtcacataccacggtttatccaatccctgattttttttttttttttttttaagacagagtctccctctgtggcccaggctggagtgcactggcaggatctcggctcactgcaagctccgtctcctgggttcacgtcattctcctgcctcagcctcctgagtagctgggactacagtcgcccactaccatgcccggctaatttttgtatttttagtagagacggggtttcactgtgttagccaggatggtctcgatctcctgaccttgtgatccgcccgccttggcctcccaaagtgctgggattacaggcgtgagccatggctcacgtgagacagagtttcactctttttgcccaggctagagtgcaatggcacgatctcggctcaccgcaacctccgcctcccgggttcaagtgattctcctgcctcagcctcccaagtagctgggattacaggcatgtgccaccatgcctggctaatgttgtgtttttagtagagacagggtttctccatgttgctcaggctggtctcgaactcccgacttcaggtgatccgcccgccgccgcctcgccaagtgctgggattacaggggtgagccaccgcgcccagcccccgttgatgtattttaaagattttcctctatttttgtcctatagacgattctgtagtaactatctatgttattatgtagatagggttcttcagataaacagaactactagaatatgtatgggtgtatctatgtgtacatatattcagagatttattttaaggaattggtttatgtagttgtaggggcctgacgagtctgaaatctgtgcaggcctataagaaggagttagggccttagtctcaacttctggaaaaatctcaatttctgctcttatgacctttaggtgaactggataaggcccacccacattatggagggtaatcaagagattatagatgttaaccatatctactaaatacttttcacagtaacacctagattaatgtttgattaaataactggctactagagtctagccaagttgacacagaaaactaagcaacacactgtccttccatgtgcaccagagactttcagactttaaaaaacctccaccaatagtttatacacatacttaatgaaaccatatgctgatgttttctgttcttattcttttttttaaaatgctgattaggaacccaaaattcaatgtgagtagatctgaccagcaatttgaaaaacattgcatatatatgtagtctagaaatggaattgctggcttgcaaggtatccacacgtccactttactatacattgccagtttttttctctgaagtagttgaaccactgtacagccctactagccgtgtgaataaaccttctttcttacccccttgatggcaactggtaattgcagtttccttgtagacctaattattccagataggtctgggcttattttttaaggtctttaaaacttgataaaaatcgactttaggccgggcacggtggctcatgcctgtaatcccagcactttgggaggccgaggcgggcggatcatgagaccatcctggctaacacggtgaaaccctgtctctactaaaaatacaaaaaattagcagggcgtggtggcaggcgcctgtagtcccagctacaggctggggcaggagaatgacatgaacccgggaggcggagcttgcagtgagccaagatctgcactctagcctgggcgacagagcaagactccacctcaaaaaaaaaaaaaaaaaaaaaaaagtcaactttaaacaaagagacctgcctgtgttggcaccttcagcaaatattagtatctacccagaaattaatgacatttctttattttcattgtatttatattttttgatttacatatagcaaaactgaataatttttggtgcacatttttgtgagtgttaagacatgtatacaatactcctcccttatccatgaaaggtatgtttcaagacctctggtggatgcctgaaactgtgggtagtactgaaccctatatatatactatggttcttcctatgcatacatacctatgataaagattaatttataagttagacacactgagagatcaacaacaaaaaataataaaatgaacaattataacaatatgccaacatcgccaatactttggggctgttagtaagtaaaatacaggggacttgaacacaaatgctgcgatgctatgacagtccagctgataactaagatgacccaagtgactaatgggcacatagcacctacagaggggatgtggtgcacaaatggatgattcaggtactattcctggaattttcatttgaatgttttcagaccacagttgatcatgggtaactgaaatcacagaaagcaaattccaatgcggggcaccactggagtttcatataccaccaccacaattaggataccaaagagttccagctcctccaaaagctacctcagactttcttaagcttcctcacacttctagaccctggaaaccttggatctattcattatccctgtacttttgcctttttcagagtgtcgtatgaatgaacttgtactggcttctttcactcactgtaatgctttggaagtaggtctaggttgttgaatatattagtagttcactatttttgttgctgtgtactgttccagtatatggatgtactacagttggtttatccatttacgcattgaaaacatctgaatatttcacagtttttttttttttttttccccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcgcttcccagtaggggcggccgggcagaagcgcccctcacctcccggatggggcggctggccgggcggggggctgacccccccaccaccctcccggacggggcggctggccgggcagaggggctcctcacttcccagtaggggcggccaggcagaggcgcccctcacctcccggacggggcggccggccgggcggggggctgacccccccacctccctcccggacagggcggctggccgacccccccccacctccctcccggacggggcggctggccgggcagaggggctcctcacttcccagtaggggcggccgggcagaggcgcccctcacctcccggacggggcggctggccaggtggggggctgatccccccacctccctcccggacggggcggctggctgggcggggggctgaccccccacctccctcccggactgggcggctggccgggcggggggctgaccccccccacctccctcccggacggggcggctggccgggcagaggggtcctcacttcccagtaggggcggccgggcagaggcgcccctcacctcccggacggggcggctggccgggcgaggggctgaccccccacctccctcctggacggggcggctggccgggcggggggctgacccccccacctccctcccggacggggcggctggccgggcagaggggctcctcacttcccagtaggggcggccgggcagaggcgcccctcacctcccggacggggcggccggccgggcggggggctgaccccccacctccctcccggacggggcggctggccgggcagaggggctcctcacttcccagtaggggcggccgggccgaggagcccctcacctcccggacggggcggctggccgggcggggggctgacccccccccacctccctcccggacggggcggctggccgggcagggggctgaccccccctcccccctcccggacggggtggctggccgggcagaggggctcctcacttcccagtcggggcggccgggcaaaggagcccctcacctcccggacggggcggctggccgggcagggggctgaccccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggcggggaagaggcgctcctcgcttcctagatgggatggcggccgggcagagacgctcctcactttccagactgggcagccaggcagagaggctcctcatatcccagacgatggggggccaggcagagacgctcctcacttcccagacggggtggcggctgggcagaggctgcaatctcggcactttggggggccaaggcaggcggctgggaggtggaggttgtagcgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggaaggagaccgtggagagagagggagacgagagggagagggagagggagagctgtttcacagtttttgatgattgtgaataacgctgcctatgtgtgcaggtgcttttttttgtttgtttgttttgaggtggtgtctcgctctgtcgcccaggctggagtgcagtggcgcgatcttggctcactgcaagctccgcctcctgggttcaagccattctcctgcctcagcctcctgagtagctgggtctgcaggcacacaccaccacacctggctaatttttgtatttttgtggagatggggtttcacagtattggtcaggctggtctcgaacccctgacctcaggtgatcctgagcctcccaaagtgctgggattacaggcgtgagtcactgctcccagcctgtgtgcaggttttattgtgaacatatgctaattctgtagggtatatggctgaacagtggggttgctagatcagtcatttggtaaatataattatgtctttgtaaaaaactgcaaaactttcccagaatggctttataattttgcatttacaccagcagtgtatgagaatttcagttgttcccattcttgtcagcactttgtagtgttgatgccttttattttagacagcctaacaggtaaataatggtttctcatcatggctttaatttacattttcctaatggctaatgatgtagagcatcttttcatctaatataccccctttatatctactttggcgaagtgactgttcaaatcttttggccattttaaaaaaattgtgttattttccttattgttgactttgaaagttctttatgtattctggatagaagtcctttgttgcatatgcgatatgcaaatattttcttacagtccgtagtgtatctcaacagtgccttttgcagagcaaaagtttttaaattttatttttagtataccattaaaaaatgtttggtggattgtgattttggtactgtatctaagatctcctttcccaatccaaggtcaaaaagatttccatgtgtttttctttagaaattctataatttttcagttttacacttagttctgtcatctgttttgagataattttgaggtatggatccaaatttttttaaaaaaatgtttgttttgtttttgcatgtgaatattcatttgttcctgcatcatttgttgaaaagattattatttttggcttgattttgccttcgtgcctttatggaaaatcatttgatcctgtatgtgtggttctgtttttggactctattccatttatttccctttttttttcttttttttttttgagacagaatctcgctctgtcacccaggctggagtgcagtggtgcaatcttggctcactgcaagctccgcctctcgcgttcacgccattctcctgcctcagtctcccgagtagctgggactacaggcgcccgccaccacgcccggctaattttttgtatttttagtatagacggggtttcatcatgttagccaggatggtcttgatcccctgacttcatgatcctcctgcctcggcctcccaaagtgctgggattacaggcgtgagccactgcacctggccttttctctgtctttatgccaataccatacattcttgattactgattttttgtaattagtcttgatttagatagtgtaagtcttccaactttgctctttttcaaaattgcattggctgtctcatttactttgcctttctttatgaattgtagaatatttatcaattacggcaaaagaaggtgctacaattttgattggagttgcattgaatctttagagcagtttgggaagaatgccttcttaataataagtctatatctatgatctatttcttcatcttcttagatcatctttagtttctctcagcagtgttttgtagttttcagtgtacacatcttactttatccctaagttatttcatatttgatgctaatgatctttaattttgatttttgattttttttttattgctggtatatagaaatagaattgactatttactattaatattatttcctacaaccttactaaacttgtttattctggtaccattttgtagattctacaaaatgtagattttctacacagataatcgtgcagttttgattgtacctttccactgtggatgcctttatttttgttttactttagacttttattggaaatacagcaggacttatttgtctttgtattccctttggggtccctccccacacatacctttgatgacttttgttttagattctttgtagcgttagcattgttctgaagtcagaactatgtatatatctataaaaaaggtatacttgggctgggcgtggtggctcacacctgtaatcccagcactttgggaggccaaggcaggcagatcatgaggtcaggagttcgagaccagcctggccaatatgatgaaaccccgtctctactaaaaataaaaaattagctgggtgtggtggtgcacacctgtagtcccagctactcaagaggctgaggcaggagaattgcttgagcctgggaggcagaggttgcagggagccaagatcacaccactgcactccagcctgcgtgactgagtgagactgtctcaaaaaagaaggtaaactcaaaggcggtcactccatcttttttgtcatatttctttctcatctacatcctcttcccatctgcaacagaaattcaacttttaattttacctaattcatacttttcacactttgggtccttttcactattctgttacggttctttaaagtaactgcctctcagattttactaaaaatgtaaaatttcctctttatgaaacctagaacacattggtagacaaaattaaagatgggagatctggtggtatcataaaagaagaaattcgtcaaccagactgtgggtttcctagatttttgtttatagtaggttgtatgttatatttagttgcatttttccccctagagtttaggttccataactttcatcatattttcagagtaatttatttaaaggaaaaaaagtggccaaaattaacctttagaatgaataagtctgggcctaaccagtgtgaaggtatggtcactgaacctcctgtttctcgagtctttgccttctgaagatatgtgtattgtaatagatgacagccgcttgcggttaattcagtaatacatgtcagctccacccctggcacttttaaaccttttggcctactattttgcaaaacagatttttaagaattagtatgcattttagaagtttcctttcaggttaaactttttaaatagttattctttaataatgctgttaaaagaattttgggatttctattgccaagtcactaaaaagtaactcaggcagagaagggtaagggtgctgcaagcacacatgaagaattaacattttaaaagaacctttgagcaccttggcacctgtggatttcttcttggatgtctcatgcctaaaagcagagcagcatactgtaaaatcagtaaaagtaggaaaggacttgcaagtagaaatgtttcagcagactctcgcctcccccatctccatcctcactctgatgttaagtgtggggcccattgggccagatacaggtaaaaaggtgggtgatgtcattaaaaggtattgttacttatagcttattatatgtgttaaattttaataagaattttcttttttctttctcccaagccaaactggcaagacgcagtcaagaacgggacaatcttggcatgttggtctggtcacccaatcaaaatctgtcagaagcaaagtgtaagtcttggagcactttattttccacctttcttgtttaatgtaaggttttaaaggtacctttgaaggtaaaagcttctatatgtattaaatttcttttctattttaagataaataatttaaagagttttaaagtgtatatttctttttttaaaattttttattttttgagatggattctggctctgttgcccaggctggagtgcagcagcacgatctgggctcactgcaatctctgcttcctgggttcatgtgattctccagccccagcctcctgaatagctgggattacaggcacccattaccacacccagctaatttttgtatttttagtagagatggggttttgccatgttggccaggctggtctcaaactcctgacttcaggtgatccgcctgccatggcctcccaaaatgttgggattacaggtgtgagccactgcgccctgtgatctgttccatttttgaacatgttctttcttacagagcactaaaaatctgcctccctgtaatttgtaaaagctttgttttcctgaactttgctaaataagtttgcttccatatgtgtcctttaaatgttcagtcatcgtatctcctttactgtctgagtccaagctagttgcttcaggtgccttttcagatggtttttttggggatctcttttcatctcctgttgtccttctaagtgtgttccagttggccacaatgtccatcttaaattgtactcagaactgaatatgaagaatactgagcattttttgaacctttatgccagcacagtactaaaatgtttttcatactcctgtatcattcagtgttcacagtaacccaggaggaagattttttctctgttttacagatggcatcccatagttcaaagagtcagagggttgtaaaagtagcacagatagtgagtggcggaaccccaagtagttcactcctgggtcataatctcacttatttctcaggctgtgttcatttagcctgttagccactatctttctgttattacagtttaaagttgtattagtcacttttcctattgtattgcttattggagtctttggagtcagaatttaattttaatgttatcttatttttcatagacctagaagaaaagggcagaatatgtaaagttaattgatttttaaacagtggtgttgcctataaaataaatttacagttttattgtaagccctgattacaatcgttttaagtttaaagttggttaaaactttaaactttaaaaaaactaacctgtccactgaggctcccagtggacagcgagctcggcttgtggctgagacacacttgagccaggccagaggcataggaggaccaaatttgacagatatcaatacacgattcttactgaggcctttgaaacggacccttgtcctggaattactgtcagaaaagaaccggccagaaaaacagactcccgagccacgagtccaggtttggtttcagaattggagaggtggagcacggaaaagaagccagagcagcgccagcgtggaggccacctgggcgcaggtccccccgatcccagaccctggtcagcctggggtgctgacccctactgttccaccagcggggcttccccgggggtcccaagcaatgtgggcaacttctcttgggaatcggaggatgctttgggccaagctctcctctgggggcgcgctgatgttccgtgcgcgaatgtggcccccgctgacctggagatggcagccagtgcgctcggccacgcttagggagatgtcccttgatctccgccctcgggcccagtgctgcttccgggtccctcttgccaccagcccttcccacagctggaagctggcagtgctgggcctcaagttcatcccggggcacccggcctgctccccatacaccagtccctagctctgcgggggctggggctgcaccctcctgctgtggagcagcagccgaggtggggctggcagctgggggaggcgcctgggtgcgccgtgacctgggagcagccctctccgccccagcccccgcagctctgaccgtatcccgcctctctgcctctttcctggccatagtcacagccacagccatcgcaggacccggctgagcgctaggaacaggttccttgtcttcctccagaatccaactcgcacgggaggccccagcacccctgcccccaacccgctgcggagtctgaacctcaagcggctgcatagcaaacccgtggaaatgacctgtcagtgtcaggcagtggaagacagatgaactaagcaagggctcatcggtagtgttcacgttatgaaaattgaagagaaatatcaagatttatttactttgtcacggaagggcttccagacatacctttcagggaaatcgagttgttagggtggaagggccttggggtgcatgagacctaggggttttccttagatggcataaaaaaggattgactttatagaatacatctgtctttccatttattaaccgagtaaacacggagcactgagagtgaacaaagtccactagcgagaaggcaggatgaggacggctttgtagaaatgcattattttctatcaggaaagagcaatgatttctactctgggaaaaaaacaaaacaaacacttacctaaaagtaatatttacatattgttgaaagttcatagataaaagtataaagaataaaaaaaattcacctattattccatcacccagaggtgataatcgttaaacattttggggtatttcttccaattttttttgtatgtatttatataagtgagatgatagattatctgtgtgtgtgtatgtgtgtattgtcttcctgagcatcggacctaagcagtttccacgttgttaaaactgcttataaaggttttaaataactaggtgtaatactttattacatggatatgtcagtatgtttaacaattactctattgaaaatttaggtgtctcagttttggaagaatatggaagtcttggttgtccagcatttattctgacattaagtagaaataagtgatttaggacatatttctagcagatactaaaaaactgtgtataggatgtctggagatccctggcttttcttgtgtgtgtgtgtgtgttttttttttcctcttcttttcaaagtggctgttcagagttctgcctcttagggttactgaaagcttataaagttatgttgtaattataaaaataaatgctattttagaaaattcaaatagtacataatgcataatatataattgttttccacaaaatgtgaactgttatcagtctgctcataagtacatctgggactttgtttcatctcagtatatctacagttatctaatttttttttactgtaactagtatggatgtatcataatttagcctttttttaaacaaaattacctgtattacctattgatgaatatttataatcttagttctttttttaaactctgttttttaaaaaacctgatccgtagaatgactctagtttaacattaatgaattgtacatttcttttttttttttttgagacagaggtttattcttattgcccaggctggagtgcagttgtgcgatcttggctcactgcaacctccacctcctgggctcaagagagtctcctgcctcagcttcccaagtagctgggactacacacgcaggcccctgcacctggccttgaattgtacatttcagaatagctagaagagggctgagtgcggtgtctcacccctgtaatcccaacagtttgagaggctgaggcgagctgatcacttgagctcaagagtttgagaccagtctgggcaacatggtgaaaccccatgtctctcaaaaagtccaaaagttagctgggtgcgtggcatgtgcctgtagtcccagcacttggaggcagagatgaggatgcttgagctcaggagttcaagaccagcctgggcaacatagatctcccctctattaaaaaaaaacggggaggcgggggctagaagagaataattttgaatgttcctaatatagagaaaatgtaaatatttaggattatggatatcccagttaccctgatttgattatatgaatgtatcaaattatcacatgtaccctggaaatatgtacatctgatatgtatcagtaaaataaaatacatacattttaagagaggatcttggctctgttgtccatgctggagctcagtggcacagtcatagctcactgcagccttgaactcctgggctcaagctgtcattttaaaaaaagcaatagtgaagatttttgccccttaatacatttcttattttcttgtttaaaatagattttatattttagagacattttagcttcacagctaaattgagcagaaggtacagagtgcccatttatcttctgcccccacacacccacaccctcccccagtgtgaacatcctgcgctggagtccaccaaagggatacgtttgttacaatcaagcagcctacagtgacacattcttatcacccgaaattcatagtttacattaagcttcactcttgtgttgtatgttctgtggattccgacaaatgtataatgacctgtccaccaatgtagttatcatcgtttcactggtttaagaaacctctgtgctccacctgttcatctccctctctgcctcctaaaccctggcaactgttgatcgttttactgtttctgtagaatgccttccagctggaatcatatagtatgtagccttttcaaattggcttctttcacttagcaatatgcatttaaggttccactgtctcttttcatggctggatagttcatttctttttagtgctgaataatataccgttgtctagctatgccacagtttatctggtgtattgtcatgctaggaacccctctcccacccccacattacaaacagactgatgtcttctgtcgtcttctccttttttacatcgttgtttcaactgaaattattggattatattttttccttcacttacattaaactcatacatactttgtgcctggacttcattcttttcagtgtacctggctctatatttattcttttaggtgaatcttagatttgtggtaacaagttctgtccaaaagtatctcaattcagattatacggaattcgtgtttatctactgagttttcatttacgttttatattgaacagctttttgtctgggaatgtaccaggagtgaaaggttcaggaatctcatactgtaatggagagacagaaaaaatgaacatgtgagcaaataatttatgtgtagttttcctaggcaactcttcctttttagaggtagaaacactggggtctacagaagtaaagtcaagtgtttaaggtcccatagccagttattacagtagccaagttttagctagatctcttgtctccagacaatatttaccacacctgtctgcctttgtaggctgcttcatttaataaactgtaattcaacgcttaaaacattaatactatactagtttttttgggctgtgtctaagtaaaacccatttaatgagagatataacttatgggatatgcctagaaaatgtggcctgtagagagacatttcatgttgaggaagcgtaaataattcccaataacatagattagaacaatgagtttaaatattaagtgatcatggaaaattacttgatgaaaccatggcttgagatttcagcaacaaaggagtgaatgaagtacaatctgccatcatgtgtaatctggagggtggcagactgagaaactgaaaaatgttcacttattggagaagagtacagttgactcatatgatttttacatcaagcatctcccatgtaccactgagtcagtattctgatgttcccgttgggactcagcagaaggtgctagctttcctaggtagaaacaaagagttgaagatggttgacatttgattgaaatgtggaagaatgagtaggagtttgctggctggaccaggggcataagtgcacactagacagaagaaatgatagcatttcctttttttttttttttttttgagatagaggtctcgctctgttgcccatgctggagtacagtggcgtgatcttggctcactgcaacctctgcctcctgggttcaagcagttctcctgcttcagccctgcgagtagctgggattacatgcgtgtgccaccacacccggctaattgtgtgtttttagtagagacagggttttaccatgttggccaggctggtcttgaactcctgacctcaggtgatcctcctgccttggtctcccaaagtgttggaattataggcgtgagccactgcgcccggccagcattttcatttttaaaggtgtgaagatgtggagaggaaatccagcacttaattttggagatttgcctgactgtgacaagtgttgtcctggggcagagagaaatgaaactagaaaggcaggccagcttcttaaaggtttggaggatctcttgacggagttttagctagaactgatatgatttacactgaaaagctcttgacagtcctgtggtttagagaagagtagagaagaggtttattggtggtagtaaggtgttgatgcaattccaagtcagagaagttgattgcctaaccgggtcagtgctgttaaaaggcggcatgatggaaattcaggaagtcaagtcaggagtatcttaacttgccccaaagagatggagaccatagaattgtgggcttagtgactggttcaggcagcctttaacatgcctgtaaagactattaaatgccgttaagtataggtgcactgttccatcatttactccacacgtttctgttgaacccctatgaggcactccgttgctgtgatacggtatcatctctcctcagtccccactgtgatattgtgcagccaccctttgcatggattccacaccctacctctgcacatcctgtttataccattccaggctgcccgcctttggggactccatcctcattccagttgatctgcaccctaaatgcccaccttgctcagccctacccaccagctttaggataccacctcttgccttcatgcagacaccactgcactgcgcagtgtacttttgacagtcccctcttgtcactgtgcttacgtgtagacctacctcaagtttggacttcgtttgtttagagaagcagctgaacgttaacaaagtgggcgtattagagtttaaaatatatgtagagtttaggccagattgtaggcccagtctggttccttttactgacttaggaaaaacaaagtttacccaggcacgtgtggttaaatataatgcaaaactgtggtccaagggtcttaatgaaatggatagattaatctgaggattttttttttgttgcttgattattattattttttttaaggtagggcttgaaaagaaggggagtggaactagaggggaagctcgggtatagccttgtctgttgtttatagtctgctttttaaaaatatataatcaactaaattgctcatgctgaatgatgttgatagttcccagaaggagcaaatttctcagatgggctgctgttgccttgggtgtagaatttagcaaggtgacttttggctattggatatccatagaaacagatggtcttgctcatttatgcattatgcattttataagttatatatagtaagtgtttgtgcagttatttaagtgtttgcattttgggttttttattttataaaaatgaggaaaaactggtccagtggtaagaatcatggatctctgtgttaaaatagacaaaaatggaaatcgttagctgtgccaaaaacaagctggctgatttttttgagacagagtctcgcactgatgcctgggctagagtgcagtggcgcaatctcagctcactgcaacctctgcctcccaggttcaagctattctcctgcctcagcctccctagtagctggaattacaggcacccgccaccatgcccagctaattttttgtatttttagtagacacggggtttcaccatgttggccaggctggtctcaaactcctgaccttgggatttgcctgcctcagcctcccaaagtgctgggattacaggcgtgagtcaccgcgcccggcctgattttttttttaagctagctattaactatataaggaaaaaaattgcatgtaacatggtggaggtagataatttaaagttgtgtcaaaagacaagtttaagttagggatttaaaagtaagttttagctttcttggaataagagccgtacctatgacatacgcacaattcatttctactttaggatgtttgacttactatattgtacatgaaagtttagagtaatatgaataatgtgtaatatatcatatataattctaaactttcatgtagatacatagtaaatgtcaggtgtctctattcagagcatcccagtagcttttcaattcattgtaagttaaagtcaaaagaacctgacacaccctgggcagcatggcaaaactccatctctacaaaaaaattaaccagtcatgatggtgcacacctgtagtcccagactgttgggaggctgagatgggaggatcacttgagcccaggaggtccaggctgcagtgagctgtgattgcgccactgcactccagcctgggcaacagcaggaccctgtcttaaaaaaaggaaaaaagaaaataataataacacaaaaaaagaacttgatgtccacatggctcaccccccagttcattctggttattgcttaagtgtcactatatcagagaagccttctttgaccacacaaaccactcactgtcttaactcactttctttcattctgcttatcatcaccggacatcgtattatctactttatgtctctcgtctctctccactgtagtgtaaaactgagtggaggaacttggtatgtgtgttcagttctctgtcagtcccctcttggcatgtggtgggtgtataataaataagttattgaatgaatgagaaggtggtgggagtgcaggattcccctggatagagatttgcaaatacaggcttttctgccatttgctctgtaacttgggttgtctggaatcttataacatttccttctttgtcccttaccttgtggctatcatttgtttactcagtaacttgcacaactgcttgtgtaccaagcgctagcaggcactggcgaaatacacgaacagtccgacaagtccctgcccaagtgtagcttacagtctacgggaagctgcactggtaaataagttcattgagcgccgtgaaggagaagtgtgcttaaacaaataccacatattctcacttacaagtgggagctaaacattgggtgcacatggccataaagatgggaccaataaataagacactggggactacctaggatggggagaggtggggacaagggcttaaaaagaacctgtgctgagtgagtcatgggttcatttgtaccccagacctcagcatcacgcagtgtgtctttgtaacaaacctgcacacgtgcccccgattctaaaataaaaagttgagggaaaaaaacaaaacaaaacaacttattctttgacttgggtgtgagcagcagtagcgatagggtaagcctatattggcctagttttcagctttttaaaaatatatggctagaagaggttgaaacttgtgattaaaatgagtcttttgagtgtgtgaaaagtattttcatcactttaatttttttaagtgctctagaactagctaaaatgggcaaaacgtactagaataaacatagctgaatgagttgaatttacaaactagtggaagccttctattaaacagtaatttaccttgtaatcatattaatgtctaatctgtatctttatacagaaaaacgtttcattgtgttcagttttagtttatcctttctgttgacagtggacatccattatcagttcttgactattacaaatattactgctggggaagcattcttggacctatttcttgatgcccatctagaatatatatgctaagttctgagagatcagtgccaaattattttcaaagtggtcaaactggtttacactgctaccagcaaaatgcagaatttatttgctccacatcctctccaataattgctgttgttggacttatacgtgttagaccagtctagtgtgagtataacactgtttcatataccaaggaattttgctgttttagttaggtctgttaatggcattggtgttatgaaacaaatattcccacattttaaaaagaggtgtatattgatatatgtagggatgaaatgaaataattgggatttactttaaaattcttcagcacatgtaaagcacattttgggatcagttcaccaaattgttctgtggatgcagattaaagtattgtttccgtgtttaatttactgtcctgtggttatgtaggacagtatacctacccttagaaaacacttgctgaatgtttaagagtactgggtcataatatatgaaagctgctctcaagtagttcaggaaaaagttaacacacacacacacacacacacacacacacacgcttatttttattattaaaaatagcctctaacttaccccaccatgtggacataaccactattaaagtttgcttccggatcttttcggtatgcttatatgcactctgattttaagcacaaatggttacatcttctatgtagtggttttcaactttaattttcctgcaattaaaaattaaaccgagttttgatcctgaataatatcacatcttgtagcatactttattcaactacatctctccttccttccttccttccttccttccttccttccttccttccttctttttctttttctttttttttttttttttgagacagtcttgctctgtcgcacaggctggagtgcattggcacagtctcagcccattgcaacctccgcctcccaggttcaagcaattctcgtgcctcagcctcccgagtagctggaattacaggcatgtaccaccacacctggctaattttcatatttttagtagagttggggtttcaccatgttggccaggctggtcttgaattcctgacctcaagtgattgacctgcctcagcctctcaaagtgttgagattacaggcctgagcttctgctcccagcccacatcccattcttgaacatttagatgttcttcttttttcctcctataaataacacaagtacacaggaatttataatgtcctctccccagttgaaaagaaagccctccttaattctgcagatcaggtttctcaattatgtgcattcatagttctttttctcggtcacttacgacaattggaattcatttgtatgactatttctctctctccagtcagacatgcgggttccataagggcagagattgtctattttaatcacagctatcaaagcagcaccaggcacacagtaggcctgaaagatttgttaaatcagtggagaataatttcaacataaacaatatattttataaaagatcactgtgttgcaacttactttgaaagctcttaaataacttgtttgtatagcagtgcttatggaaggctactctattggatgaagaatagaaaaccctccacattgcaaacagtgggacttaacagtgggagggcctgcccctcccaactccctctcacaggcaggagagcctgccctctcatactcagtctcacaatggggtttagcttccttttcagagctaaagaacccacccagccttcctataacacagactctctttcatctttaatggacagaatcaagattattgctgccagagatagaaagttggggaaaagtcctcgagggtccccttctttgtttggagcaatttgatgcaggtagcttgtatttctgtttatctgcttcctgtttcgtcttttatcttttatccatcaccttaagcatttatgcttttttttttaatcttaagaaatgggggttcactgtgttgcccaagctggtctcaaactcctgggctcaagtaatcctcccgtcttggcttatcaaagtgctgggattacaggctataagtgtgagccactgcatctggccaatcttttgttttttgtatgagggtagctggagcacttttaattttctaaggttaaaaacttacctttgcttcacttaaggaaaccatgtgagagatcttgaaaaatgcacttttcattttcatcactgccctaccagcaactactggtgtactctgccaagataagcttcagacaagtcacttctctggggattggggttggagactgacttattctgtaaagtgggattttaacaaactcccactaagaaatagctttaaaaaatttatttttttgagatggagtcttgctctgttgcccaggctggagtgcagtggcacaatctcagctcactgcaacctccgcctcctgggttcacgccattctcctgcctcagcctccccagtagctgggactataggcacccgccaccatgcccggctaatttttttgtttttgtttttgtttttgtatttttagtagagatggggtttcaccgtgttagccaggatggtctcaatctcctgacctggtgatccacccgcctcgtcctcccaaagtgctaggattacaggcgtgagccattgcgcccggccaagaaatagcatttttataaagaacgtacattttgttacctacttggaaggacggattgatgaaatcctcaggcagagtctctggcttggcttcctgtgctgttttccaccccagagagggagcgttcagatgtttactgtagtaatgtctgtacccaccaggtggcacaattgctttacttaaatgatttaagctcattttgattctcagcgaggtgtgataactcatttcttattttaataataaaagatgccacaatatttgttactgtatttttaaagagaatttttgcatgttcagttgagtgatgagagagaaattggtgtcatgtttcctctgtggtacctaatcctacagcaagagtttcaaaaatatttttttaaaaaagctctaagaaggctataagccttgtcatcagcccaccatatggtgccagcctattgctttgcatagaatatccaagatcacacagtgttctgaatatctgcagtatctagggggagggaagggtgagttaaggttactgtggcaattttcatctgcatttctcccttcttttgcacttgagacttactgagggtactagggcatttcgttcattgaattaaaatgaatatagaaacaattgaagtttagcgtccatctgtttcttacccctgctttctgtcacttcatcaaccacagttctattaacttcattcaagctagatacagtatgttgattagccttggttccctgtaccaaggaggctgttctaatctgaagagcccttctgcctctatcttctctcctcaagagatagaactgtgttggctggtccgaagtagtgagttatctcaactgattcttcacaattgcagatggaactccttgttcttctctcttcctgcttctcactactggacccagctggtcttttttaaaagaaggaaaggagggaaggagggaggaattgtgcatagaggttgtttgtttttgtttttgttttagatggagtcttgctctgttgcccaggctagagtgcagtggtgcgatctcggctcactgcaacctctgcctccctggttcaagcaattctcctgcttcagcctcctgagcagctgagattacaggcatgagccaccatgccctgctatttttttttttttttttttagtagagacggggtttcaccatgttggccaggctggtttcgaactcctgaccttgtgatccacccacctcagcctcccagagtgctgggattataggtgtgagccactgcgcccagtgcatagaggtcttaaaccttataccttatctgatatttaccagctgtgtgaccctagccagactacttctgtgagcctcagtttctttgtgaatgagagtgataatggaactatcagagaagattaaaaaaaagattgtaaagagcttaaaacaatggctcataaataataaattctcagacgttagctgttgtttctgcttgtcagtatagatgccgaacctttaggaagcattccttcattgatcattattatcatctgatgacttggcattcccatactgtcctacatctgtgttgttatttcgtgtgtttgttctcttctgttgcctgtgtgttgtctcaagctactgtgggaaatcggttcatttttgcttatttcggcttgctatttaatacagtgctttgttcatggtaagtttaattcagtacatgcttgattaggcttttggaattttataaattttcttgaagaatgaggatttcacattctgtctttaagtgatattatgaggaagcccataactcattcacctatgctctccataatggtaaaacgcagtggatggattcttgtgcttctgactgacagattggaatgtcggccaggttgcacaggcaggcctgctttgcgcaccctgtacactggggaagggtgatgggtgcaaatgcctgggcccatagaaacgtgctggcattttcttgagcagcgtggactttgctcattgtcctgattagcgtttacttcatgagtccctgccctcagtggctcctcacttccagattggtgaatttttaatcgataagggacagaattaagattgttgttgccagagttggaaaagtccccacggatccctcttttctttaagagcagttttttgtaggtagcttgtatttctcctgctcctcttccttcctgtttcatcttttattcactgacttttaagcatctgcttatctttttttttttttttttttttttataagggtagctgggaacacattttattttcttgggttgaaagctttttttttttgcttcagttaaggaaaccacgtgggaggttttgaaaagtgcacttttcattttcattgctgtcctaccagcagctactggtataactctgtaaaggaacagggtaggtggtgggaagggaatagcatcagggattctgaaaagtatggcagctatgcatgtcccttgattaaagaaaacaaaagctgaggattatgtagagcaggaatacagtaagagacaaggtctgtcaacagcattgcttgtgcagatggctatattctgagtaaactctagtccagaacattctgtgaggagaggaggaggagtacctactgtggtgtcattttcccagttaggtgataacctggctttattggtgagaactaattcttgggaaggtcagggcgttgctaaagataacatagtcatacagtgctgactgtgtgccatgcactgctagacaaactcattttattttgagacagagccagaatttgacccgggtctttcttaccctgtacataacctgtgctgccttttatcttgtgggacaggaaacctcatatgttgacattgtacataatacagcaccccaggcattcattcagcaaatgtctgtctgatttttgttggacattgggaacaatgaaaagaatgaaaaagtgtatatttgctagtaggtattagatggtaattccttttacaggttagagggctcctggtacattaacttacttcatcacaaccttccgagcacctagtagacacaccatgtgtcttcatttaagtagttactacagtagagtgctttcttcctttactttagatttgagtcatcagggtgatcttccaagaattttttttttttttttggacagggtctcgctctgttgcccaggttggaatgcagtggcacgatcttggctcactgcaacctctgcctccaggattcaagcgattgtcctgcctcagccttccaagtagctgggattacagacacgcaccaccgtgcccagctgatttttgtatttttagtagagatggggtttcaccatgttggccgggctggtctcgaactcctgacctcaagtgatcctcttgcctcagcctcccaaagtgctgggattactggcatgagccaccgcacccggccatccaagaaaatccaaaagttacatgactttaaaggttaccttagtaagaataccttattgtttacaatatggcagatgtcctatataacctcagctgcagcattcgggatctactgttactgtcttgttgttcctgtcaccagctgattcttaagatataaagcaaaagaggagttgaaaatggagtagcattcaacaaatgcttgtgtgtgtcttaaaatttgtagctaaatctggttgcagacagtgggcacaggcattacaggccttgttactgatgtagcaggagggactctgagcagataacatatgcccaagaaccacaggcaggactagcccctgtgctgggccactccagggactcctgcatcactttttcagcctgtgcatgtgtttgctcaaagatcgtgctactggtgatcatacatacattccttactcagttaaggtagataatagtgtgctctgagacttgagatttacagcagaagcttaaggttcatttgttgttcattcaccaagtatttattaaaggaaggaacccttcaagccagttttaaacaagcagaccttctccagagttgaccctcaatttaccgcagattgttttcgccttctgtccttacatattcctgagtgcatctcatgacctggtttttaatcagctggcctgctgtctgtttctaggtctggtatgctgccatttgcatctcatctcctccagtatgaacccccatattacctgtgtctctctgcagggttctggccaggtatacagaaccacctgttcgagcagcctcatctgacattttttagaatctgagagcacttttatttggcataatctaatgtattgtgaaggaaaaagcaagggacacactttggagtaattccctgccctgcctttttttttttgagatgaagtcttgctctgtcaccaaggctggagttcagtggcacgatcttggctcactgcaacctcagcctcccaagtagctggaactacaggcatgcgccaccacgcccagctaatttttgtatttttagtagagatggggtttcaccatgttggccaggatgatgttgatctcttgacttcgtgatccacctgctttagcctccggaaatgctgggattacaggcgtgagccaccgcgcctggcctctgccctgctttttaaaatcaccagttatacttttgtgacaagctatggtcatttcatttgtcatttgctgaccttcaagtaaattgaaattttactgtaatctgagtgaagtaaccagtttgtaactattttaaatattaaatcggaaattagtggcttagtattagaattaatattgagctgcagtatataattagttattgtttgaattaggttgactttttcttttgtcaatggaatatttttccccaatttttagaatacatgcttctataagagttggaattctttttcaaaattgatttctgtttcctaaattggttgacagttctcccagagctgggagcatgcttttggtataatcgcatggcaaactaagttgtagaagctcagacttttattaggactcctctgtttactctttgtgtcatagtgggaaagtggatcactctgagcctgttttctctaagtttggccattgtacctagagagtaagatttaggagccaagagggaataggggctagtcaggattttactgcctacttcatacagttctatgctccttgattttttttttttttagcttgtgttgttgttatttttttaattcataaaggaaaatcatgcatgaacatatggcagtgctattgactagtgcattattttttcttgtacacttgggaagaaagactagaatatcctcagggaggaaattgattcatctttgggggtggcagcttctcctagaggttgagtcaattcattttccttggtattttccatggttcttgaaagctagccaccttatattggagtagtacatatttgaaagcaaataccaagcactgggtcacgtaatctatctcttaagaattttttaaaacataaagaatagtttgttcattattcaacctgagctgaaactaaaaatgacgcccaatttcatatttctttttactgctagacatgttgtttaaagtagtacttgtttgttgtagaaagttttaagtagaactaaagattttgtcttccttttccctttttctttttttgagacagagtcttgctctgtcaccaggctggagtgcagtggtgcaatcttggttcactgcaacctctgcctcccgggttcaagcgattctcctgcctcagcctcccaagtagctgggattacaggcatgtgccaccacacctggctaatttttgtatttttagtagagatggggtttcgccatgttggtcaggttgctctcgaactcctgacctcaaagtgattcgcctgccctagcctcccaaaatgctgggattacaggcatgagctgcagcatccagccctgactaattatttttaaaaattatttgtagagacaggatttcactatgttatccaggctaatctagaactcctggcctcaagggatcctcccgcctcagctttccgaagtgttaggattacaggcatgagcctttgtttttctcttttaaagaagactcataatctcatcaccaggtgatactgctgttaatatttgagaatattcattcagacgtttctctgcaggatcaataactattataatggttctgttttgttactgtgtgttctttatttttagtcttgtacaggacaagtgtattagtccgtttttatgctgttggtaaagacatacccgagactgggaagaaaaagaggtttaatggacttagagtttcacatggctaggaaggccttacaatcatggtagaaagcgaggaggagcgaggagcaagtcatattttacatggatggcggcaggcaaagagagcttgtgcagggaaactcccctttttaaaaccatcagatcttgtgagacttactaacaggagaatagcacaggaaagcccatcctccatgattcagttacctccagttgggtccctcctacagcacttgggaattgtgggagatacaaatcaaaatgagatttgggtggggacacagccaaaccatatcagcaggcctgaaatatacacgtatatcaattctagcagaccatagggtgtactctgtccctcagtttgtttaatggcatctcttcttgtttttcagtggatgaatacattgccattgccaaagaaaagcatgggtacaacatggaacaggtaatatcatggttttctttcttttgctgttaaaaaatgagtatttgtaactaaataattatatttttttcttctttgtattgagtagcagtgtttcttcattagcaactttttggtaattactagtagtgttacacaaactctggtcttctttttcttgttcaagatgaatattagaggaccctttgatttgaaaggcatatctgtcatctgcagatctacagcctttaggacactgattacttagtgattactaaggagctggatgcttgagcataatgctttctcatttgaatatgtgatttgtttgtcattcttctggttgtatcatgatgttttttgacgcatgttttcacattcttacctaaagtgttttaatattcaccattttgaatcattttcagtttgagatggagtctcgctctggtgaccaggctggagtgcagtggcgcatctcagctcattgcaacctctgcctccggggttcaagtagttctcgtaattctcgtgcctcggcctctcaagtagctgagattacaggtgcacaccaccacgcctggctaatttttgtatttttagtagagaaggggcctcccaaagtgttgggattacaggcgtgagccactgcgcctggccaagattttcttttaaatattgtttggaatgtactaataagaaatccacaagatttatttttctgcaaaagtgtggtgataccttatttcagctttaatgatttattttaaacacatcaagttggattaatgctttccatggcattaatctagatcttacaacctggaagttactgacatttcttatttttctgaatgatggaagttaccaagagtttagattatgtgaaattgtaccctttcttttggacttggccttacatttaattactctatcctggtcattgaagctacttttgattgcaaaatatacctgtatgaattcttaaggatggtagtcttgatcatttctcctttaaaaatgatcattagcatgaaaatttcctatattataattccagcataaaaattaccattagcaaagtattgctggatctcatcttacctcttttgttgcttattctatttctactttttttctttctaagctgagaagacctttatatatcatatatataacatataaatatatataatttttaaaataaaagaataacagcaattgttctttcataaattacttttttcatttatatattgaggcagtaaagtgtgatacttgaagagcacagatcctagaactatgctggttctgtgaccagaggcagggaaaggcagtgcctcagagaagaccttcagtttatactcaggctgatcctcacaatggaggcaagcctacaaccaaaagaaaacaaaactgtagtaaaaacatagcaaaccctgaggaagagtgtgattatgagtttactacattattagattcagatgtccaggttttaacagaaaaatcacagagcatacaaagaaatggtaaagtatgcccattcagtagaaaaaaattaatcaacagaaactgtccctgggaaaagaccttagtggcagatctactaggcaaagattttaaaacaactatcttaaagatgtttttaaagaactaatggaagatacagaaaaaatcaagaaaatgatgtatgaacaaatggaaataacagtaaggaaatggaaaacctgaaaggaaaccaaaatgaaattctagaccctaaacacttgaaatgaaaaattcactagacgtgctcaaaggcagattggaagagtctcaacaaagaacatgaagaaaggacagtggaaatgatttgagtctgagcagcaggatgagaaaagattgaagagtgaacagagcctaaggtaccctagggacacaatcgggtggactaacatatgcatgtggaagttgcataaggagtaagagagatagggacagagagattacttgaagaaataatggccaaaaatttcgcaaatttgttgaaagatgtgaatataaacaaacatccaagaaactcagtgaactccaagtagaataaactcaaagaggctcaccagagcacataatgaaactttgaaaagacagagaatcttgatagcagcaagagagaactaacctattacatataagggatcctgaataagcttattagggtatttcttgtcaaaacctttggaagccagaggcaatggtctgatatattcaaagcagcaagagaagaaaactgtcaactaagaattctatatctgagaaaattctttcaaaagtaaaggggagaaatgaagatattgtcagttaaaagctgccggagagtctctctgaagagaccacagtggagctgaacttgccaactggtaatcccatggtctataaattggacaagaacttgaagcccatcaagcccatgaataaaaaaagttcctggggatgaagagaccattcataaagccatggaagctgtggctgcccagggcaaggccaagaagtgaaggccagcaggctgactgctctctcaaggagcactctccctgcccaacccattcttcttcacctccctgctgcacatgccacaccgaccacatctgcaggcatcttacgttggagctgcagatgggaactcatggctcccattttcattgtaatcagttttgtctcctgcacccactcccttcatataatctagtcagatagcacctctggtgcagggagaaagctcctcttatccaagagagttgagaggtagtgactagggcttttgccagggcttgtttactaaggacctttgtgggaggaaccatgctgtcatgaccaaagaggagaagcaaagagggcctgcttgaccccaggacccaatcctgtactcttctctagtcatgccactgtcaggagagctctgctcattccagtggaagatgacagtaacctgcacggtgatgtgaaaaaacaacgatttcctccctgatcccagggtaggtggctctagaaggttgagagcaatcctgtattaagttcatgtgttggatttacttttacaaaaaattgtatgtataaataatacaaaacaaaaacccttctgagattttttattttatttttttgagatggagtctcactctgtcacccaggctggagggcaatggtgcgatctcagctcactacaacctccgcctctcgggttcaaacaattctcctgcctcagcctcctgagtagctgggattacaggtgcctgccaccatgcccggctaatttttgtatttttagtagagacagggtttcaccatgttggtcaggctggtctcgaactcctgacctcgtgatccactcacgtcggccttccgaagtgctgggattataggcgtgagccaccgcgcccagcccccttctaggatttttagtggcagttcaaatagtcccacatgtggtcatcagaaataagccattccatcctggacaacatggcaaaatcctgtctctacaaaaaattaaaatcagccaggcatggtggtgtgtgcctgtggtcccagctacttgggaggatgagatgggaagatttgttgagcccaggaggttgaaaccagcctgggcaatatggtgacacctcatctctaaaaaaaagtttaaaaattagccaaacatggtagtgtgtgcctgtagtctcaattactctggaggttgaggtgggaggatcgcgtgagcctagaaggcagaggttgcagtgagccaagatcatgtcattgcactctagatcacaactctatatcaacaacaacaacaacaacaaaaaaaaagaggggggaaagaagccattcctcacaccaatatgggataagctccttgacctctaagggataggattgcatcctgctgtgggttttcgaatctctcccctaccttgttttgtggctgtgaaatgcctcatgatcatgtccaagtatgtctttcactggctgatttccgaatcacgttctaattgcttggccctgccatgtggacccagtattcattttgagcataactgtactaaatctttctttctagatcagtgtaataaaggtgtaatgtgcaacttaaaataaataaaagcttgtgtctttttgtttgttttgttttgagacaaggtcttgctctgtcatccatgctggagtgcagtggtgtgatcatagctcactgcagcctcaaacccctgggctcagtcaagcagtcctcctgcctcagccccccaagtagctgcagttacaggcgcgcaccaccatgcctggctaacttgttgttgtttgtttgtttttcgtagattcatggtcttgctaagttccccaggctggtctccatgttctgagctcaagtgatcctctcacctcggcctcccagagtgctggggttacaggtgtgagccacaacacccagcctcagaaaatagctatagaatatatacacaaggaaatagaaaggaatttaaatctttcactataaataatcaacaaaacataaaaaggaggctggatgtggtggctcacacctataatcccagcacttcaggcagatcacttgagctcaggagttggagaccaacctgggcaacatggcaaaaccctgtctctacaaaaaaaaaactagctgcgcatggtggcacgcacctgtagtcccagctgctcaggaggctgaggcaggagaattgattgagcctggaagggagaaggttgcagtgagccaagatcatgacattgctcctccagcctgggcaaggagagtgaaaccctgtctcaaaaaaaaaaaaaaaaaaaaaaaaaaaacctaaaaaaacagtaattcaggaaatgaaggacataaaaaactttaaggaatgtacaaaacaaatagccaaatgacagaagtccctccttatcagtgattactttaaatataaatgggttaaactttccaaaggacagagattggcataatgggtaaaaattacaggatcccagtatatacaagagatttacattagttccaaaaacacaattttaaagtgaaagggtggaaaatggtatcccatgcaagtagtaaccaaaagaaagcaggagtgattataataatatcagtcaaaatagactttaaatttaaacaggttgtaagagacaaggacattcactgttggtgggaatgtaaaatggtacacctggtggggaaaacaggatggcagctccttaaaaaattaaaaatagaattaccgtattatccactaattctacttctggccaaagtgggtagatcacttgagcccaggagtttaagaccagcctgggcaacatggcaaaaccctgtctctacagaaagtacaagaaattagccgggtgtggtggcatgtgcctgtatcccagctacttgggagactgaggtgatcaaggaggattgcttgagcctgggaggtggaggttgcagtgagtgccactgcactccagcctgggtgacagatccagaccctgtctcaaataataataataataataataataaattttttaaaatttattttagaagaattatttatagtttctctgtgaccacttccctgatgatacatatgttgccatacttaacaaataccaccttcccttgttgctgtacctaacaagttatcaccatcctgaattgtatacttatcatttccaagaaaaatatttttattgtatgtgtaatttccaattaaaacatattgcatattgtttgaaaattaaataatttatttaaattgcttcactctttcttgatacttatacctatattaaaagacattatacctataataaaaattacatcacctgaaaaaaaagtatgtgtatattaccacagttacaaagaatagaaaaaggggcctctgacagtgtctgccacttagcgctgtagatgagttagtttgtctaaatatgaagtcgtttttacttttcttttgctggtctcatttccattttcattgttttttgtttgatctaaaattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcagcttagtacatgctgctctgtggatgggagttttccagttacaggagtaaagcacttctagcacttcccatcctgtcgtctgtgactggaccctccccacccaccccagtccctcttgttgggactcccaaaagattagacccatacgaaggactttttttttttagacggagtctcgctctatcaccaggctggagtgcagtggcatgatcttggctcactgcaacctccgcctcccgggttcaagcgattctcctgcctcagcctcctgagtagcttgggactacaggtgcgtgccaccacggccggctaattttttgtatcttttttttttttttttgagatggagtctcactgtgtcgcccaggctggagtgcagtggcgcgatctcggctcactgaaagctccgcctcccgggttcacgccattctcctgtctcagcctcccgagtagctgggactataggcgcccgctaccacgcccggctaattttttgtatttttagtaaagacaggatttcaccatgttggccaggatggtctcgatctcttgacctcgtgatccacccgcctcggcctcccaaagtgctgggattacaggcgtgagtcaccacatccggcctaattttttgtatctttagtagagacggggtttcaccatattagccaggatggtctccatctcctgacctcgtgatccgcctgccttagccacccaaagtgctgggattacaggcgtgagccgctgcgcccggccttaaacatttgatttttaaagattacttttttatttaaataaaccaactcattttttatgtttagcttccagataaatctatagcaagtctggtgaaattttactattcttggaagaagacgaggactaaaactagtgtgatggatcgccatgcccggaaacaaaaacgggagcgggaggagaggtgagcacatggctggggtgttgtctaaccacttaggggactatctaagagccccagatacacaaaggcaaggcagaatgactggttttccctccgcgccttcctggtggaaccacatgttcatgagatgtattagagcgtgtcacattattcaggtattttttctcaccactctttccctgcagtcagtgaacttccattttgagtcagttaactttgacccattttttttccttcccatttagaaggggtggctccttttaataaaaaagaatcttttattttgtagtttgaggtttaacgtggtatatttttacaagattcatttggtgtgtttttatgtttgccatgtggaaacaaaaatacaacttagagttgctgcttctttttttgaccatctgttttttgtgtgtgaatgagaaagagaaacattttataatctcttagtaaggatattagttttaaggatagctcagtatggagaatacttcttaaccatcacttcctcagtcttatatgtagcatagagaagtagaaatggccaggtactcacactcagaaatgggctctggtctcagctctgaagattccacttacatgccacaggctacactgggatgtttaaggtctttaatttattttttaaaatgtgtaaaattgtacatactcacaggcaggtgacttcaacatgcgtcttccccaagcttctgttttccttaactctaaaatgaagatgtttgaagtccagaaggcagcatgcagacctagtggtttccttgttagggtggtgagatatataggtgggttttaaaaaatcctattttccacatttcctgtaatatttttatcaattaataataaaaaaataaaatgaaggaggatgaaatatatggtccccggtgtcccatctcaggatggaattttatcatttcaaatgaaagagtaacatgtgagaacacattgaaagttgagtatcacttttggagaattcaaacctcttggcccaagtataaattgagagtgatgttaagaacatctccaaagctcttttaattgtaagagcctataaaattatcgaccatgatacatctgcatatttttgcctctgacttatatactagtaggtttatttatggatgagtactcttattaacttttaatgaagctttttcatttccctagtttactgtctatatagtaagtctgttactataagcagatgcagtttactaagcagcaatcaaaattaaataatacagagtgggattggatatccttgagtgtgaaataagaatacctgccaacacttccattcttactccctggaggctttttttttgcattagtcccgatggggccaggaagtgctttgcctccacctcccatgtgcacctcaaccacttttgggatgcggggatggaggtgctgcagcagcacctgataaattgttggctttctaacaggacttgcctgtgaaagtcatggcagggactgggacaaaattcccttagccgaaggctctttcttgttgtggacactctttcctcagctagagcttcctgctaccttggtggaggatggggaggaggtggcgcgtagtgggcatggtcccgtgggatggattccagaggcagtgcgaggtgggcaaactggggcaggctacttgacttctgtagacttagttttctttttttacagttgcattcctacctacatcggggcttttcttgtttctttgttttaaattaaatgaaatactacattcaggatattacaaaaagcatttaaagtgctataccaatgtaagttttctttttaaaattaaacataattttaaaacatcagttgtccaggacaccagaaaagcctcagactttgtgtggccttgggtagaaagacggtacttggaaaaggatttttttactgttagcaggtttattcccaatgcagtggaaatttattctcccataatttctcagttttgtttagtaatcatatcctagtcctcaatagataattatgagaaaataacatgtaaatgcattttcattttgatattttcagtttacagatatagagcaatagtgttttagatctggattgggaagttaggaatctattttagtagtttctcatcacttagactgaaagaactatggagttggtattctgtttgaattacaaagatgtttttatctcagcagcctgaaaacatactaattttatattaaatcagtttattatttatatttggtaaaattagtacaaaattttcagttaaatcaatttatcgtttgtattcggaaaattagtacaaaataatcattcagtaacttgttcttgtcttccagcgaggatgaactggaagaggcaaatggaaacaatcccattgacattgaggttgatcaaaacaaggaaagcaaaaaggaggtattttttccccctagtattgtttaggcgaataaattttattactagtttcataaataaaacattcatgttgcttgttctacttaatatattaagtgctatgtggaaagcagcatgatatgactatttttcaacaatactgtctttgctttatagattgtataattttgtttgctaatagatatgaataaaggaaggcttaaaggatagaaaatagcactaatgagtaatgatgttccctagaacagcagtcctcactgactttcttcgtaagccattagctcagtaggttaacaagtggtctagtgaattccaggcagccttagggtctccattcacgctatagatgccccagcgtctgcccatcctaggcacccatgccgtgcctggggtgactgcagggagctggcagggactcggcacagccctcctgttactcagaagcagcaatttggtcacaccagggggagccaggaccatcctctctcacatggtgactgtttcatcttatcattttaaaaaatcattatacaagagattgtagtttctggattcagggggctcgtgaacctctacaattgcatgtaacttttacataggttcatagaggtatttttccaaagacacagtctatagtttcaaaaaaatttctcagagagttctctctctctgctccaaattataagaatagttattattttaagcctataaaaacagaagggtctaaatttatctaaactttaaaatgacatcagtaatatatgtttcttatagacaaggtaggaaatacagctaactgaaagaagaaaattaaagtgatttataatattatccataatcactgtcaaccttttggtgactttttcctgagaactctttctgtaaaatgtatatgcctgtatattcataattctgaatctagtcactttttaaaaataatataatggaagctttgtaatttttagaaccttttaaatttactctaccttgattttttttttctcttttttcttttttgagacagggtctcctgtgtcacccaggttggaatgcagtggcaccatgactcactgcagccgccaactcctgggctcaagcagtccttccactatggccttgcaaagtgctgggataacaggcatgagccacctccagcccttgattttatttttttttattttgtttttgagacagtctctcactctgttgcccaggctggagtgcagtagtatgaccttggctcactgcaacctctgcctcccagattcaagtgattctcctgcctcagcctaccgagtagctgggattataggcacatgccaccacgccctgctaggtttttttttttgtatttttagtagagatggggtttcatcatgttggccaggctggaccttgaatttttttttatgtcaaatatatttgtatacgtagctatatattattctgtcacatgaatgtttcataattgagttaccttatcctatgtggatttcccagttgtttattcctcctgttttttgcttttataaacaatgctggattgattctcacataactcactatctgtgctcatagatttttttcattagaaccgattcctggaagttgtattgttgagtcaacgtgttctagatacattgttaaggcttttttttttttttttggttgtatatcaccaaattggaaattggtcgtttttttctgcataatttatatgaatgcccaaataagatcctgagggttagctaaattagattgtttgggaaatcaaattgtagttgtagtttttattaagctttgtgttgatgtattgctatttactaggtttttcagtggcacattttaaatgagagaaaacacttgatttcatacatttttataattcttatttatataatttctgattcagaaagaaaatggctaaatcattgttttttttttttttttttttttttggagatggagtcttgctctgttgcccaggctggagtgcagtggtccgatctcagctcactgcagcctctgcctcccaggttcaagcagttctctgcttcagcctcccaagtagctgggattacaggggcccgcaaccatgcctggctaatttttgtatttttactagagacggagtttcaccatcttggccaggctggttttgaactcctgacctcaagtgatccacccacctcggcctcctaaagtgctgagattacagccgtgagccaccacacctggcccgtagtttcttttttttttttttgagacggagcctcactgtgtcgcccaggctggagtgcagtggtgcaatctcggctcactgcaagctgcgcctcccaggttcatgccattctcctgcctcagcctcccgccattctcctgcttcagcctcccaagtagctggggctacaggcgcccgccaccgcacctggctaattttttgtagttttagtagagatggggtttcactgtgttagccagggtggtctcaatctcctgacttcgtgatccgcccgcctcagcctcccaaagtgctgggattacaggcatgagccaccatgcccagccacctggcccgtagtttttttaagtattaaaatgatactagaacagacgtagtcagttggtgatctttattaaacatcgtagtcccatacacagcagtttattgcctactaatatttttgtattacccacttgttgaagaaattatcactaccattatagttttgcagtgtctttagctcagtcttttaaaatatgaagcagaaagtcatattttcagctttatcagtgaatgctaatgcactaacaagatggaattatgagcaattataaaaacttcttgttcttaaaatggttaccagtaagttatattctttaacttgacaagattttactgtgtttcatttctgaaagttttggttttacagaaattaatagccgtcatgcattttaaaatgataaggtatattattttagagtaagttatataagttgccgtaaaaattgtgttatccaaaaatgtgtataaaaagctgtaatttcatgtagctaaatacagatgtgtgtgtggccacaaaactcattagcagagaatacagatttttttctttctatattactagaggaagctgagaattcttattttcattggcttgaaacgatagagtaaggaagtatttgtacaagaaggagtggaacacagtttcattgtgtttagtcaaaactcagtagcccaaattctgtctgtgaactgcctgttagaatttatagatctcatttggttctgatagggcatggtatttgtcttagattgttttggtgccatgttaaggaaataaatatgtttattactgatcatttgactttttttaagtttcattcatcacctgtgtatatcatgcaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacaggtactcataagcctggtcttggatgtaaaagaattaattagcactttagaggtgtttctgttattcatatatgtgaatgttctctttccgcaaatctcaaaggagcattttgtttcgaaggaattggacagatcttaagtaccagcccattgtttttctttttaatgaacatataaattgaagtgtatggatatagtgtgatctgaaagtatttctgaagtatatagcaaagcatatgaatatcatatttatattatatatgtgtctgtgtctccatgatttctcacaatatgaacataccctagtaacctgcatctggatcaaaaaatggaatgttgcccccaggcccatgcattttccctcctggtcactattccatggaatgttgcattccctcagcaactccacccctcttttattacctgactcctccttgtaggtggccactattctgattttttttttttttgagacggtgtctcgctctgtcgcccaggctggagtgcagtggcgcgatcccggctcactgcaagctctgcctccccagttcatgccattttcctgcctcagcctcccgagtagctgggactacaggcacccaccaccacgcccagctaattgttttttgtatgtttagtagagacggggttttaccatgttagccaggatggtctcgatctcctgatctcatgatccacccgcctcggcctcccaaagtgctggaattacaggcgtgagccaccgcgcccggccctgattttttttaattttattttgtttttgagacagtgtcttgtcctgttgcccaggctggagtgcagcggtgcgatcttggctcactgtaacctttgcttccggggctcaaatgatcctcccatctcagcctcccaagtagttgggagtacaggcgcttgtcatcacacctggctaattttttgtgtttttggtagagacggggttttgccatattccccaggctggtcttgaactcctgagctcaagtgatctgcccgcctcagcctcccaaagtgtactgagattacaggtgtgagctaccacactcggccctgttctgatttttaaaaccataagttgtttttgtccatttttgaattttatataaatgaaagtcatgtggtactgtttattttatgtctggctttctttcaacctgagagctaaacagtttttcaaagtggtcctgtcattttatgtgcgttttgtttgcacatcagcgtttcccagctgtagcactatcctcatgatgggccgttctgtgcactgtaagatgttgagcagcatccctggtcttgacccagtagatgctagtagcaccctcccctaccagttgtgacaacagaaatatccctaggcatcaccagattacctcacaggggcaaaattgtccccatttgagaaccactgctctacatcattgccatattttggtagtcttaaattttagcccttctgatgggttataatgatgcctcattgtactttttatttggcagttccctgatgactaatgaggttgctcaccttttcatccatttgttggtcatttggatatcctcttttgtgacatgtctactcaagtctcatctgttttttttctgtcaggttgcgtattttcttattggtttataggtgttctttaggctctgagttgttttctacaacttgtattttaaatgctgtaaatatgttttgcattctgtgactctcaatggtatcttttgatgaacagtaattcttcattttaaggtagtttagtttcttagtcttctgaggttagtgtttttgagttctgttcacctttctcaaggtcatgacgatattctctcatgttagtcttagaagtgttgttttaccttttacattttgatctagaaatgtttttctgtatttgttgttacatgtcggattaatagtcactgttttgttttcatatgagtatcaatttggtcaagtatttattgaagaaactgtcctttatcctttgcaacgcagcaggacctttgttttacatccagtgtctgtatgcatatgggtctggtttgaggttctctgttcctttaatctctttgtccatccttcaccaatacatactgtcctaactttatgtactttattaatttagttatctggtgtaatataagttctccaagattgtcttggttatccctggccttttactttccatataaaatttagaattactttatcaattttcagaaaaataattctattagagttttgattgggattgtattgcatctatagataaaaatggagaattaacatctttattgagttttctgatcagtgaacctgatatacccctctacttctataggtttgtaatttctctcaatgttgtattgttttctgtgtaagaacttaacgcatcttttgttagtcattccatgatatttggtacttttttggtgctcttgtaaaggatattgttttttaaattactttttataattatttttgcctgctatgtagcttattattttaatctgattgcatagtacatttaaactgaaaattcaacctagtagttgggtcctgtcctttcattctctctctggaattcagtttccagaaatccatcagcaagttgttgactgactatttttggtttttgctgcttttgatttatcttgatggttcccttggaaggtcaaacagtagaccaactgtcatctcatagacgcgaagagcagggcgtgctgctgtctttcttgtggtttagggaggcagcccagaccaggacccaagcacactctgtgtgctcagaggagcggcttcttcttgtggctgctggcacagctgcactctaatcttaggagaatcacttaatctttctaggcctcttttcaaatgagattaatcctggcctgcctgatctcacagaatatgtctgggctactgtgtgagagagcatttgaagttctgtttgcactggaagaactgtctcgggctgtgagctcttgttgacattgtcatcttcctttacaaggatgctcctttctccctctgctgagtgagctcctggtggttgctgtttaatatattgagaaaagaaaaagaggccttcctcttgcaccgaggtgttattgactccatagggtgagagagaaaagattctttagttttcagagcagggtcaagagcaagaatttttaaaatttgaaggtcgctcacaattatgaagagggaggactcagcctcactcagagaggaggtgggtgatttcctttccacagccttttagcgccacagtgcagcagtgtgttcattgccaaatgtgcttctagactcaaaatgggcagtcagtccacttgggccacttgttctggaggccgccatgtttggtatatcaaggatatattctgaaaataacagcaaactcgactaacaacagcttaaacaatttagggtttatttttctcaaatggcaagaagtgccaacatcagtggctactggtgttagttcatgtgttcagtcatgctctcagggacccaggtacttttcaggtcttctactgtgccattctcagctgttggcttttcatcttgcttgttgcctcatgttggaagctactggagccattttgcaaccctcacatctgcattcagggcagtatgaagaggaggtgggggtggaggtaacctgtctgtcccttttagcaggacaagcaaaagccttaccggaagctccttagctgaattctgtgtgcccgtgcgttgcgtactgctcttcctccttcccaagacatcatcaacctctaccagcgagaagggggctgggcatgtctcttaaattagccagtgaacagtgctggttgcatcaggtctttctctgagtggagaataaagtgatctgatgttaaaagaggaatcactgtgcccacagtaaagtagaaaacagaaagttctgtatgactgagggttgggtgggagggtggtgtctaggtagggcgtcaggacaagtggatggcttttctttttcatcttgttttttctttaagtgtgattacctttgcatcctatttcttacctatttcattgccactcactttccagttagcatgatggtggcagtaatctctgtttttttcctgcttaataaacactagatgtttggcggggggaagggggcgtattttgttttttggagacaggatcttgctctgttgtccatcctgggactgtagtgatacagtcatggatcacagtagcctcaaaggcctgggctcaagcagttgcccacctcagccccctaagtaggtaggactgcaggtgagcaccaccacacctggctaattttaaaatttttttggtagagacagggtcttgctgtgtcacccaggctgttcttgaactcctgggctcaaatgatccttcctgccttggcctcccaaagggctgtgattacaggtgtgagccactgcactagcataatttttttttggcagggtctggcactgtcacccaggctgaagtgcagtggtgcgatctcggctcactgcaacccctgcctcccagactcaagctatcctcccacctcagcctcgcaagtagttgggactacacagcctagatatttcttcttcttcttcttctttttttaaaattatactttaagttctagggtacatgtgcacaacgtgcaggtttattacatatgtatgcatgtgccatgttggtgtgctgcacccacttcgtcatttacattaggtatatctcctaatgctatccctccccactcccccaaccccacgacaggccccggtgtgtgatgtttccccatcctgtgtccaagtgttctcattgttcaattcccacctatgagtgagaacatgcggtgtttggttttctgtccttgcgatagtttgctcagaatgatggtttccagcttcatccatgtccttacaaaggacataaactcatccttttttatggctgcatagtattccatggtatatatgcagcctagatatttctgatacggaaaatgcatcaggaagaggggtataggctactgagcatttagagctagcttttagttcagaattttagatgttttgcatttactctctctgcttcttttataacgttacttaatcacagtgcaatatatacccagttttgtactatctatgaacaaccagctagagtgacaagagtggtctgtttcactggaatgcgaagaggacatgtaatattctaaaccttgactttttcctgccaaaagttgctatgttgcatttttagccaaaaaggaatccagtgaacataatctgagtactttgcaattttcctgggttttcggtaactgaaagaccactgagcaagatcctaagagattgtaatgtctagcatggcagccagcagccccatgtgtggttgtttaaatttagattaattacaagtgaaaaaaatttaaaaattttcgggtagcatcttctactcatgaatgtcttttacattttacttgagaaaatcaagctcctcttccgttggctttcttagttgcttgtgtgattattcaaagatgaaaaatgctggagttcagagttccctggtgcttgacacggatatgccctctacttggagtagagagaaaatagcatacttccgtgacctgtctcattcaagggtccatgggaaaattaaggagcagccatagcctgggaggttggtattgtttgtggtctttctttcgactgggtaaggacagtgaaagattaccttgagccaaggcagtaatgtggaaaaagataatttgtaggaaagtgaagacgtgacagttaatcaaagttagacttctggaaatctcactgacattgtgttttcctcgcccccccatcattaaagaaatctatgcttgtgcacttctgccctgtgtagaagcggtggacagcacagtgatcttggggcgctgtgaggctgcacccgcagttctgttgtaaagactgggcctttttggtccttactgtggctgctctgttacttcagttcaatcctatgtggtagtaagcccagggatttcttctgtcttttatgtaagactccaggtaggtgttttgctgctcaggtatcacctgttaggaagctgtggatccaggactgtgtacgtgagagccctccgtcccctcctccttgggttgtaccttatctgttgctctgaacaagcaaataataaacctagttagatgcttcaaaggataccatagggatctcagaattcagctacaacagatgttagtaacgtctttactcttgggtttttgtttctttaggtttttaagttctgttttcatacctttatatagtttttatttttaaaatgaaaattattttttccttcctagatccagaatattaaacagacaaacagtgctctcaaagaaaaacttgatggtggaatagaaccatatcgacttccagaggtaggattatgttaacatcatcttagaagtcatattcaagttttacatgtttaagaatttaatatcggtgtgatacatccccagtatacatctcttggaagagtatatggacataattttatgaacccagttgatgttaaaattccgataagagaaaatgaaaggttcgttaagctcataaggacatactcatctctaaatgtaatgtgctaaaatgactcatttggatatccaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgactttaaaaaaaaaaaattttttttttaatggaaaaaaaagagcttaggagcattggtagattttagggaaaagttacgtcctgccctactcccagcacctagattcttggacaattatgtcctagtggatatcattttagccaaattactgtattcctttgggcttttttcttttcctttcccacttctcacaagttgtaaaaacttaaccgggaaccctgagtcttctaaaggtgtatttcattttactagttactcatcgagctctgactagccaggaagtacaaaaccccaaaagaagcagacagagtgttcagctttaaaggttgggggtgctctggacctgcgataccaaaagatgaatgcagaatgtccccaaccctagggcaattgctgggtgacttcagctgttatgtgacatgtaatgggaagacagatatcaaaatgacagggtcggtcatctccagaatgtgtctagaattggctggtactttttcctactctaataatacacgaaattattgcctgctgttaaaagcctgtatgttttcttatctggataaagaggtaagtgtcacttgtggttttaaaaaaatgtttttctcttgtattttaaaaaatgctttcttacatccttagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggtaaatctgaaacaaaacagtcacttctcttgtcaggttcacgcttgatactccagtttctaaagtgatgaattttttcagctatagagatttttaggtatcagctgtattagtaacttcactcttacctgtaaatagccggaatgtgtatgcattgactccagttcttggtgcctgtatattattcacatgttaatttctgggcaaatcctgaattacatcctgatttcctccagctacaaaatactctgcattatcagtttttccttaaatacagtaaaatcttgagtgacaaagacaggggagtgggggcataaacaaaaagtaaaaatgcagtgaaagctgtcctgtctgtgagggatgtcgatgaagctccgtcatctgcaatgtgcagtcacatcatcatgacgcagcacagcgagccagccaggagctcctgaggcctctccctgctgtccagatctttcagcctttgatgctctttggggctgattggcttaagtattgatggggacagttctgtggctggctggaacttctgtgatggtggctaatttctggaatgataaccctggtctcatctgtcacctccctgcttcctgtgtcaggggcacctgccatttccccatctagcctggcctgccttgctgttacatttgtccctctattcccagagcagatgagcctggggctgggcataagaaagagttacttgccaatcactttgcatctgaatttgttcacaggcatggtaatttaagaattaatttagctttgtaaggaaagtcactttcacatcaaagccttttcaaaccatactggaatgttttgagattacctattttgtattgcgtgtgctaccattttgctccaagggcctggctctggaaacagcccagaaggcccctcctgacctgagcatggaagtacctcgtgaggtattggcatcccctgggagcgtggtgccgccactccatgcagggcctctttgctgactggagaaaggacctcaaggcacagccatctgtaagaacaccattgaaacatattaaatttgttagaattagattctttagagccttttgccagaaaatctttataataagtgtaccacgtctataatattgccaaggtcagtacccctgaatcacccccatgcatagctctgcctgaaaagagcatgtgaattaaatgatggtgtttttatctttcagcagtgatttttttctttattattatttctttttattttcagtgatttttgtaccagcactaattgcccctgttagcactcagtttcggaagcattgaaaagctggagactgctggggaagaaccattagaatttgcaggaatgaaagcttgcttcttgtgtgtgtgttttccggcttcggtcccaggatgactggaagcagaaacagttgggaacgctggctctattccctcttcgcatttgatcaaagccagtgttggctgggctggcataacaaatctcatagtaaatttaggaccaagagtccctaccaacaggatgtcagttgttgtgcatatgtttttttcttcattctcttattcttggatcattggttgactgacttaagtgagtcaagtattttttttttaaccttgttattagcccagaaggttcttccgtaatgatccacttaccgtgtggattgcattatcaaagtaccgtctttcttttcacagtctagttatggctcctccaagcagcagatcatagtttttccttggtgattgatcttccatgtctctatttacccagccttctctgcaaaacaaaatgaagaatggtattatctaactcgtgtttagtttcatagtccttatatccctttacaaactttttcactccgctagtcatttaaaatgtaccccctcatacctttcttttcttttttttttgagacagagtctccctctgtcacccaggctggagtgcagtggctcaatctcggctcactgcaacctccatctcccaggttcaagtgcttctcctgcctcagccctcagcctccctagtagctgggattatgggtgtgcaccaccatgcttggctaatttttgtatttttagtagagatggggtttcggcatgttgaccaggctggtttcaaaactgctgatctcaagtgatccgctcgcctctgcctcccaaagtgctgggattacaggcatgagccaccgtgcccggcctatttcttgagtttctttctttttctgcttcttgtagtgccacccctgccctgccacctagttttatgttctccatatgttagtttgcagaaggaaattaatctagtgaccagctgcttctctgtgtccaagggcctaagggaacttgttagaatgctggcttacttgtctgtctggtgagtccacagaacttggggtgtgtgtaatttcacctttttatttgtcctgtagagtccaacagctgagaaagatgtctgctggtgtcttgcctgtcccttctgccctcaggttttatgtattatgcagaagccacagggagaacatgagaattcctagaagttctagtaacagaatggtctgtcagttatagattatttccttcagggcttagaggcaggtaggtagcccaaggcattttgagcttttgaaattcatagttatttgacgtggacaagggtgggttgggaacagtgtcatatccaaccttacactgaagaaaggatgccatggattggacagaaagatgtcacttaaaattatgaaatgattaagtctgttaccagtgaggagaaatctcctcctgtatctaagaacagttcttgtacatggtatggtttttagctgaaggaacaatcactttgcgattttggatgcatggcccagttgtttctccagcaatgagatgccatgagcatggcagagagcagtaagacgctatgcagcctttaggtttgggtctgggagtcctttttaaaaaatgggagaggggagttaggaaatgcctcatagcttttaaagaagatcctgggatcgtatgggctcctgtatcccagctagaaccagtgactgggtgctgaacgggctgggtgccacagcatgccctcaagccagtgagaggagttagggctgccactgtgcttatatgcccttttcaggtttttttgttcatttgtgtttttgagacggagtcttgttctgttgcccagagcaagtggagtgcagtggtacgatcttagctcactgcagcctccatctcccgagctcttgattctcgtgcctcagcctcccaagtagctgggactacaggtgtgcgccaccacgcacggccaatatttcttttcagtagataggttttgcctttttggccaggctggtctcgaattcctgacatcaagtgatccacctgcctcagcctcccaaagtgctgggattacaggcgtgagccactgtgccgggccgttttcaggcacttaaatttaatcctggtgaagtaggtattatcactatgtgtcttctgcacatgaagaaactgaaactcaaaaacactgataacttctttgcacatattggggtttgaggccaagacgtctggctggagaggccacacgcttgccctgcccttaagaacatggtgggctgggcgtgggggcccacacatgtaatcccagcactttgggaggccgaggcaggcagatcacgaggtcaggagttcgagaccagcccggccaacatggtgaaaccccgtctctactgaaggtacaaaaattagctgggcgtggaggcaggtgcctgtagttgcggctacttgagaggctgaggcagaggaatcgcttgacccaggaggcggaggttgcagcgagccgagatagcgccactgcactccagcctgggagacagagtgagacctgtctcccctccaaaaaaaaaaaaaagaactcggtgtttgctctgcaggtttgctggctaccttctcttttcagtacactggaaatagcagcttgtgttgtttacctactctttgatccttttttttttttttttcctcttggcctcaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcattttctgcacccccacgctccatcaaagcagtacccttccctgtaacaaagtggggttctttctttccttttaagtgaggcttggggtttccaaatgttgaatttcttccaaatcagaccctgtggaaacactgccagggatgccttttgtttttagccttttgctctacctgaactgacattcttttttatatatgataattttatagttggaatcaagttgaagcacatgaattcataaagtttgtgatagttgtgggtttaaatgcaagggttcagtaagaggcatttttccccccatgggtggattttcttttttcagcctgaccaggcttttggcctgatacctggaggcaggatggtggcagtgcagaggcaagatcactgccgctgtggcctctgctcagccaagagtgcatgcacaccagtgccggtagtttcctgagtagcgtgaagaagctggcggtggctgtggtctcatggtcttccctttattagctgggatgtagaatttgattagatgactactgtagattggggctagaagtccagtgcactatccattgtgccactgagcttgctcactagataacttctatagaaacccaatttctaggtccaggcagatggggcccctgtgtgtgactgcacagtgtaggagggttgtagaagggtgaccgggtccagccttcccagcgtggacagtctagtggaggacactgcacatatcctccaggtgacagcagtcagcaccacggcgagtggagccacagctacaggcaggtctgggagggaggctgcagctgcctcgcatctaatttagagagtgcctgtcccggagctgagcctgtggaaaggggagagggtctgcttgggtgagggtggcacctaggggccgaggccaagagtgttgggacctccgctgtgatttgtgaaggtggcttgtggtctagaacaagaggaaatgagtgccaaggacagagaggaggaaggttgaggccaaggtggccccctgccaagatgctgctggacatctgctaggttgggcactgaaggtggagccatttggacttggcctttagtgacttcaaagaaccccgggcgatggctgaggctgggaagagggagctatggagggttgagggagagcccctctcaaagactggcctaacttgagcgcgtgcaagggcacaggataggaagggatagcaggcgggctgtgagtcccgagtcagacacatggaggccctggctccagctcccttttctcggactgagggggaaaaaaacacctgtatacaggtgtagatgaggcgcctctgtgcctcacttcccatcatcttggccctccccacaaccccggcttcagacaggtgtgactgcagcaccctgaggtaggtgacctaggggagctcaggaacagcagcctggaagtagcagggagctccatccccaggggcagctctgggtaatctgggtaaggcagccatagacagcagctccccctcagcggccccctgcagagaccagctcagaaatggtctaggactgattctccttccctgcctcactttttctggccccctacttctgttgcctgggattggtttctaaagcaaaccatttacccacaaagcctcatctcaggctctgcttttgcggggaatctaggccaagacagcaccacagtgagaattacaaggctcgggagaggcctggtgaggtccctgccaggcctgtcccagcctttcagcttatgggagggagagatcttgagagcacttggtgctgacactgctggaaaggccatagtacccacgcccaacggggagcagctgcactgcttggaggcaggtgctggctctcagaagctcccttccctgcagctcccaagcaccgtgcttcccacgcgccaagcacatgctaggcactgactcttggagctgacaggtatttgaggctctatgcaaattgcttgccttctcgacagatcagaggccatgcctggggcatcatttgggcccagactagctcatggatgaccctgacttattctttgttttggggtctttttttttttttttttgagattgaatcttgctctgttgcccaggctggagtgcagtggcatgatctcctctctgcagcagccacctcccgggttcaagcaattctcctgccccagcctcctgagtagctgggattacaggtgcgcaccaccatgcccagctaatttttgtatttttagtagagatggggtttcactgggttggccaggctggtctcgaactcctgacctcatgtgatccccccaccttggcttcccaaagtgttgggattacaggtgtgagccaccacgcccagccgatcctttggttctgggctgaatggaacccaccccccaagagagccccccaagtacactttcctgttgtcccagaagcaggagcacagtcacaggccttgaagcatccgcttgcctgcccgctctgccagctcaccctcccttcaccgtttcccaactgcctgggtgctccgtcagcacctgaggactccacagcgctcacacctaaagccctgttcccagagctcagctgcccctggaccactccacccccatgcccatccgtgcctccaaattacacaaagtctgagactaaaacccttttccccggcacctgtttctgcatcttctgtggtgtgtgacactgctgtgtatctggtcgccaagttagaagcactttgatcgatcactactgccagggacagcacaagtccttcttcccacccgagggggtgccgcggcctcctaactaacctgcccctaatccccaccattcctcttgccttttctctcccaccccccacctaatcagggacctctcctgtggaaagcggaaagcattgcatctgtctcccagaaaatgcacagcccttcattctgccctaacctgacttcaggggtgcggccaggcaccttcccttcagctcggcctgccccgggcccagtcatgcgtccccgtccgtctctggtcctgacgaaccccttcctccaccttctgcagggggactgattcttggggcctctacaacttaagcctcattctgtgctgacctctttgtgctaactgtaatgaagtgattttaaatttttattttagaaatagttaactagcgttcctggtataaaaggcctacgtgaagtgtgagtttctcatccctgtcctctgatcacctagttctctccataggcggccattgctgccagttccttgcatatccctcaagggatgatcacacatttgcgggcatgcatgtgtgcacacaaatgacatactctacacactagctttgcccacctgacacactgatagtcttcttagccttcctgcatcagcacatatgtctaaagtcactgtgggccgggcgcagtggctcacgcctgtaatcccaacactttgggaggccaaggcgggtggattacctgaggtcaggagtttgagaccagcctggccaacatggtaaaaccccatctctactaaaaatacaaaaaaaaatcgctgggcatggtggtgcacacctgtaatcccagccactcgagaggctgaggcaggagaatcacttgaacccaggatgtggaggttgcagtgagccgagatcgcgccactgcactccagcctgagtgacagagtgagactgtgcctcaaaaaataaaaaataaagctgcttcattcctttgtattggcttcatggtattccatttatggcggaaatgatttatggaaaccatcgtcaattgacaggcacagaagtatcctttgtaacatcagcagaatggaaatcacgtcacttcacctatgtgccagtgtagttgcaggataaatagaatctctggatgaaaagatctggttcatttttccatttgatacgtactgctcactggccttccagagcagttgcatcagtttctcctgtctgcgtgaacaaggccgcttgttgccccacgcccttgctaacgctgtgataattgcacattttgatctgaggtgtttgataagctgtcgggctctctagattgagctccttgaggtcagcactgttgtgctctagttccccacagctgggaataataggcacatagatgtgtagtaacggaatagagaaatcgggtgcattgcggaggaaaaataaacgcctgctggccccgtgcttacggatcaaaggccctgccatggcttatgagtgactcccagggagtgggattcccagctgccaattcctgggtgtccagagaggaattagctgaggcttagggttttctgggcctttttcttgtttattgagctgtctgctacttaggtatttattgccaaaggactaggggaagaaacattcaaatctgaaggcctggtgattgtagatttttttttttttgaaacagggtcttgctctgtcgcccaggctggagtgcagtggtgggagcttggcgcattagaacctgcacctcccaagttcaagtgattctcatgcctcagcctcccaagtagctgggactacaggcatgcatgcaccaccacgcccagttaactgtttttgtttttgttttgagacagagtctcactttgttgcccaggctggagtgcagtggcgtcatcttgggtcactgcaacctccacctcccaggttcaagtgattctcctgcctcagcctcccgagtagctgggactataggcgagtgccgccacacctggctaattttgtatttttagtagagacggggtttctccatgctgcccaggctagtcttgaactcctgacctcaagtgatccacccacctcagcctcccaaagggttgagattataggcgtaagccactgcacctggctgtagattttaaatgagattgaattccggattctaagtcctccccctccctccattccttggtgcccttcttaccatccacgctccttaatggggagttggctggctgatacatgtgaggagattggccaagttctggcctggacaagctgaagacaccttcctgccaagatggggcaggtagtgcttctcacaactacactggaagcaggaagggatggtcccacctgcgcagtcatggggaaggcatccgggaggaagggacagttgaataaggacagcggctcgcccgggcaagggtgagtggcagcacaggaggaactggccccttgcagtcaagtaggctgtttccttgtcaatggagggtattagaattttgtgtggttcaggccaggtgcagtggctcacgcctgtaatcccagcactttgggaggctgaggcgggtggatcatgaggtctggagatcgagaccatcctggctaacacggtgaaaccccatctgtagtggcgggcgcctgtagtcccagctactcgggaggctgaggcaggagaatggcgtgccaagttgctactactccgaagtagctgggtttacaggcgcgcccctgcactccagcctgggcgacagtaggaccctgtctcaaaaaactaaataaatatataaataattttaagtgtgtcttttgctatatagcaaattatttatgttttttagtaataattgctagatttattggtgactgctttgcccctaaggaccaagcatgcatttcataatttaatctttatgttaacctcacaagtagggactgtcattatctctgttctatagaagaggaagccaagacttagagaaacgtgtcttgcccacatcatgcaactagcaagtgccagagctgggccagaagcacctaaaaccgtagcccaccttacagcctctgtcactctctcggatgctgactcaagccctcactccactgtgaaatcttcttgatctcattcacgcccttaacttctctaggcctgtctcctcacatgcagagaaaggataatgggcatttcttttttctttttcattatttctgcctccagagatagcaatttttttttttttgagacagagtctctgttgccaggctggcgtgcaatggcgtgatctcggctcactgcaacctctgcctcccgagttcaagcgattctcctgcctcagcctcccgagtagctgggaccactggcacgcgccaccacacccagctaatttttgtaattttagtagagacagggtttcaccatgttggccaggatggtctcaatctcttgacctcgtgatccgcccgccttggcctcccaaaatactgggattacaggtgtgagccacgacgccctgcctgtgtgtattcatttataaacttacttacaggcactgttcataaccagtttgttcaacatcggtcacactaacacgccgttttcctcgtgcacccacgattctaggcccaggccattgctgtcctgaggctgggatgactatgtgctgtcaggctcccacttctcagagtggggaactgaggccagagagtcaaagtgacttgcccagggtcactcagctcctacacggaggcatgggctggggacccaggtggactggctttgaaacagaactcctccactgagcttggcttccagggtcactggtaagtggagggaaggtagaccccttcagctgggctacagcccatagctgagcctgtcctgaacctccccacagccagctacagcgactacagccccttgggtcttgggtcacagaccctaaggaccactgcagggatgtcctcttgatgggactggctgtggggtgccccactggcgaacatcccttataagcctggatttcgtctcatcgcaggggtacagtaggtgtgcttcagctttcctgcttctagcagagagcaccttacccaaatcctgggtggttgccagggccgacccaaactggaagccagccctctgcagctatgccctggtcattacccctccgtctcctccacctttccacccacagccccaggctgtctcaagtggacccattggcccttgagctttttcaggcccttgttgacacgctgcgtagccattgagatcgaccccaccggcctcttccttcctggagtgtgagtctgggctcctctgcagccctgggccactgagtcaaagacctcatgggtgcccacggagtactggccatcagtgccatgaggccagggcctgcagcaccgagtcgaagacctcgtgggtgcccacagagtggtggcccactcagcactgcaggctgagtgtaccactacacagcctccacagcaggattctgcccttgcccggccctgattgcaggagcggctctaatgaccgctgcaccctgatcacctttctcagaaagactgttacagtcctggtccccaggaatcatgcctccaagtgtccttgcctagtgtcgtccctttacccaccaactctgggctgggtcatggacttgttttgatcaatggaaccttcacaggcttgacatgagctttagggcctgcctgctcttgtttctgaaaactctgttaccctgtaaagaagcttgggacagcctgctggagacaggtggtcaggctgacagccaccacaaaccaccaaacctgtgtgtgaagccatctgaagccagaaggccctgatggagcacccaggagaccacacgagtgacccaggcaagccccgttccaactattcacccacaagatgcgagcaagtaaaatggcctgtgttttcagccaagttctggagcaatttgccacggcaataggtaactgagatggttggagaggagtgggactcagggaatttgtggcaaatttcaggctgcagaaaaggctgggctcccagacttcagagtccttgggtgtgtgcaggcacagcccgcagtggcaggccacagatgccttcgtggaggatgccagagcctgcctggtgagcacatgggtgagtgtgagctcctacctcagaggctgggatgccacctcctctgcctctctggggctgaaggcacagggctcccagtgcaacaccttcctatagagaacctggcagctccttggagcctcacctatgagatcctgagccaagcctcaggacccctgcacggagtggactgaacacatttagttgggggtgtacgtggctgccaggcctttcttggtagctgtcctctccacggccctccaggctgctgagcctcggtcctcttggttgaatgccttgttcatgaaggagattcagaattgaaatgtgttccccgctccccacccctcattcctctggccacatcctcctggccttcctgccccagcctacattgggctgcagcaccttccagctctgtgaagctgaatcttgcctggctaggaatcaggggcttggattctgtccctgaatcactgtgctgtgagacaagcccctcccgcccctggtgttctgtttctccatttgagtggggccggcaagagccaggtacatgccctatccctttggatgccctggtgaggaggtggccactcagctgcctccccaaccaaatggccggtagatccacagctgcctcccacatcagttgaactgggatggggtgcggggcatatggggctgggggaggttcccagcctttctgggagtagccagtaaggaccgtgtccctgcaggcctgtcccagcaaagtgcccggagctgcatgctctgcacagcccttaggctttcctgggacccagcagggtggggcggggatgccttgggggcagccagcctgaggcaggttccaaaccctgctctgcaatgtgagtccttccagttgttgagtcccttcttggtaaaaggaaatcgtgcctttgaggcatttgtcagcaaaagcatttcttgagcccctgcaatgtagctttgggcaggtgatgagcaagacagacagggttccagccctgaaggaccctgaattccagtcgggagacagagaaatggaaacatccacacagggagggtagcagcaggtttcctatgattggattagttggctgaactgtgccaccattcaagcctggggtgctgggatgggccaggaggtaaccccaggcctcaccccaccctagcccagagactccctccctgtgtagagtccaggaaggctttgtcggtgattgatctgacttccagagatgccgagcccaccctgctaggggtcgtgattcatccgtgagccaagttttaccactcagtggtggtccaaggctttcaacagtgggaaggtaggccctggatgtgccacatgaaggcagaggctggcaggggcactgtgacctgcacctttccacctccccgccccaaagctggatcgtggtctctgaatgccatttcccacggaaaggaaccatgttctttggagaagtgactggatttcgctatgggaggaaggaagtatacaaggggagcctgggaatctgatgccagagatcaaagaagcacccaaaatgatggggtcacgtccgagggacttgggagccaaactaaaggacctcctactggcctaacatgccattaaaaaaaaggacattgatcaaaacagtaaagataagaatacaaaaattaataatgataggtttttaaaaaattttttttttcttttgagatggagtctcactctatcgccaggctggagtgcagtggtgtgatctcagctcactgcaacctctgcctcccgggttcatgccattctcctgcctcagcctcctgagtagctgggactacaggtgcccaccacacacctggctaatttttgtatttttagtagagatggggtttcaccatgttggccagaatggtctcagtctcttgacctcgtgatccacccgccttggtctcccagagtgctgggattataggcgtgaaccacccgcacccagactaaagtttcatttgagacagggtctcactgtggcccaggctggagtgcagtggtgcgatcatggttcactacagcctcgacctcccggctcaagtgatcctcccacttcagttcccctgctaacccgcctacgagtagctggaagtacaggcacatgccactgtgactggctaatttttaaattttttgtgtgtgagacaaggtcttgctttgttgcccaggttggagtgcagtggtgtaatcacggttctctgcagcctcaacctcctgggctcaagcagtcctcccacctctgcctcccaagtagctgagacttacaggcacaaatcacacctggctaattttttttcttttaatttttttttgtagagacaggattttgccatgttgtccaggctggtctcgaactcctgagctcaagagtgcagtggcacaatctctgctcactgcaacctccatctcctgggttcaagtgattctcccaccgcagcctcccaagtagctgggattacaggcataagccaccgcgcctggccagcccagctaaattttcaacttttttttgtagagacagggtcttgctacgttgccagggctagtctgaaactcctggcctcaagtcgtcctcccaccttggcctcccaaagtgctggcagtacaggtatgagtcactgtgcctggcccaagaacttaagtacttttttcagtgcatgtctgctgttgctaaattctttcctttaaaaaaaaaatctggctgggtgcagtggctcacgtctgtaatcccagcactttgggaggctagagcagatggatcacctgaggtcaggagtttgagaccagcctggccaacatggtgaaaccccatctctactaaaaatataaaaattagccaggcatggtggcaggtgcctgtaatcccagatactcaggaaactgaggcagaggaattgcttgaacccgggaggcggaggttgcagtgagcagagattgcaccattgcactccagcgtaggcaacagagcaagactccatctcaaaaaaaaaagccaaaaaaaaaaaaactaaagtcatcattattttgcatttatatttgatagatgtaaaatataaattttctgtttgtaaaatattagggttttatttttgtcttctggcacattaaggatgtaattccattgtcttctagcttccatagttttaagcaaaagtcaacacacaaccattttacttctctgaaaataacattacttttttttttttttttttttttctgagacagagtctcgctctgtctcccaggctggagtgccgtggtgcaatctcagctcactgcaaactctacctcctgagttcaagcaattctcctgcctcagcctcctaagtagctgggattacaggcatgcaccaccacacccagctaatttttgtatttttagtagaggtggggtttcactgtgttggtcaggctcgtctcaaactcctgacctcgtgatccacctgccttggcctcccaaagtgctgggattacaggcgtgagccaccgcgcccagccaacattccttttttctctggctgttttaaattttttttctttgtctagggctttcatctagttgatgatgattgcctggatgtggctttgcatttgttctgcttcattatgctcctggggggttcactgagctgctcaactctgtgagttggtgcctttcatttattattattatattttagagagatagggtcttgcttcatcacccagactggagggcagtggcacaatcagggctcactgcagccttgatctcctgggctcaagtgatcctcccatctcagcctcccaagtagctggggctagaggcacgtgccaccatgctcagcaaattttaaattttttgtagagacagtgtttcaccatgttgctcaggctggtgttgaactcctgggctcaagagatccacctgccttgacctcccaaagttctgggattacaggcatgagtcgctgcatccagctgagttgatatatttatttatttattttgagatggaatctcactctgttgcccaggctggagtgcaatggcatgatcttggctcactgcaacctccgcccaccgggttcaagcaattctcctgcctcagcctcctgtgtacctgggattataggcacccgccagcatgcctggctaattttttttttttttttgtagagacaggttttcaccatgttggccaggctggtcttgaactcctgaccttaggggatccacccgccttggcctcccaaaatgctgggattacaggtatgagccactgtgcccggcaagttgacatatttaatcaggcttcaaaaatacttggtcattgttgctttaactactgctatgtccctttctgtcttttgtcaccttcaggggctgcaggtctacatttcacatatgtctctgatgctcaatttttgttttccccgcagtatttttctctgtgtgcttcagattggatatcttatactgacctgtctttgagttccctaattctaccgtctctatgtcctggctgctatcaaacccatgcaattagttctcaatttcagatgttttatattgcactactagaatggccttttatttatttatttttatttttttcaagacagagtttcactcttgttgcccagctggagtgcagtgacttgatctcagctcactgtgcaccctccatttcccagtttcaagtgattctcgtgcctcagcctcccaagtagttgggattacaggtacccgtcaccatgtctggctaatttttgtgtttttagtagaggtggggcttcactatattgggcaggctggtctcgaactcctggccttgtgatctgcccaccttggcctcccaaagtgctgggattacaggcatgagccaccactcccgtcctagaatggctttttatagactaagtctccactgaaatatttttatcttgtcatatatcttgcccattgttttctctattttctttaatatacagagctggaagaaaaactggcagaaactctgacatgagagaattgcagaagggatgagacccaaaatcggcatataagctttgctaaatctctggctgaccgcaaaactatacatgagctggcagtgagcagagatcgcgccactgcactccagcctgggcgacagagcgagactccgtctcaaaaagaaaaaaaaagaaagaaagaaagaaagaaatgccaaagcaaatttggggtaagtggaaatgaccctagatggcatctcagttctacagatagaaatgaatagcaacagaagggtacatatgtgggtagacatattaataaaaaaccagatggggggctggtggcaacccagcactttgtgaggccaaggcaggagaatttcttgagcctgggagtttgaagctgcagtgagctatgatcgcaccactgccctccagcctgggtgacagagcaagactccgtctcaaaaaaaaaaaaaaaaaaaagttactatttatttatttgttatcattatttttttttctttttttttttttttttatttgacacggagtctcgctctgctctgttgcccagactggagtgcagtggcgtgatctccgctcactgcaagctccgcctcctgggttcacgccattctcctgcctcagcctcctgagtagctgggactacaggcgcccaccactgcacccggctaattttttatatttttagtagagacggggtttcaccatgttagccaggatggtctcgatctcctgacctcgtgatccactgggaggacctcgtgatccacgcctcggcctcccaaagtgctgggattacaggcgtgagccaccgcacccggccttgttataattattttctttaagaaataatgtttcagtctgttgcccaggctggactgcagtgacgcaatcatagctgactgcaacctcaaattcctgggcttaaacaatcatcctgcctcagcctccaatagctggggctacaggtgcatgtcatcatgcccagctaattctttatttgtttgtgttttttttttgagacggagtctcgctctgtctcccaggctggagtgcagtggtgcgatcttggctcactgcaagctctgcctcccaggtttacaccattctcctgcctcagcctcccaagtagctgggactacaggcgcccgccaccacgcctggctaatttttttttttttttttttagtagagacggagtttcaccatgttagccaggatggtcttgatctcctgacctcgtgatccgcctgccttggcctcccaaagtgctgagattacaggcgtgagccactgcgcccagccacacccagctaattcttttatttttttaaaaaattttttttgagatggagtctcaatctatcacccaggctggaatgcaatggtgcaatctcagttcactgcagcctctacctcccgggttcaagtgattctcctgccttagcctcctgagtagctgggactacaggcacccaccaccatgtctggctaatttttgtatttttagtagagatgaggctgggcgtggtggctcacgcctgtaatcccatcactttgggaggccaaggcaggtggattacttgaggtcaggagttcgaggccagcctggccaacatggtgaaactactaaaaatacaaaaaaattagctgagcatggtggtgggcgcctgtaatcccagctactcgggaggctgaggggggagaattgcttgaacccaggaggcagaggttacagtgagctgagattataccactgcactccagcctgggcaacagagtgagactgtctcaaaaaataaataggcccggtgtggtggctcacgcctgtaaccccagcactgtgggaggccgaggtgggcagatcacttgaggtcaggagtttgagaccagcctggccaacatggtgaaaccccgtctctactaataatacaaaaattagccaggtgtggtggtgcacgtctgtaagccgagctacttgggaggctgagacaggagaatcgcttgaacttggaggttgcagtgagctgagattgcaccactgcactccagcctggtcgacagagagagactctgtcttagaaataaataaataaataaatagtggagatggggttttaccatgttggccaggcttgtcataataataataataaaataataattattattataattattatgtaattataataattattattattattttgagatggagtctcaatctgttgcccaggctggagtgcagtggcgcaatctcagctcactgcaacctccacctcccgggttcaagcaattgattctcctgcctcagtctgccaagtaactgggactacaggcacccaccacaacgcccggataattttttgtatttttatagagatagggtttcaccgtgttagacaggatggtctcaatctcctgacctcatgatcgcctgcctcggcctctcaaagtgctgggattacaggcgtgagccaccgtgcccggccaattcttttatttttagtagagacagggtctcacctgttgcccagcctggtctcaaattcctgggctcaagcagtcctcccacctcggcctcccaaagagctggcattacaggcgtgagccgctgtgaccagccctgactttactatttaaagcgaaaataagaatgctttattttgtatgtataataagtagatgtggtagatgactgcagcagccctggcgatggcgcaggtggaaatattctactgctctattttacttgaagtaattcaattctaattctgagaagactgggattagttaaaatgcacattttcacctccagtgccatcactaaaaaacaataatgcaaacacatatagccagaaatccaataggaaattgtggaatactaaaaaatattgtattaacacaaaagaaggcaggaaaggagcaatagacaaaccaaaagagatgagacaaaataaatattaacatggcggaccccactctaccttaactccagccgaaatcccacgtgggtgaaacaaaccctccgattaaaagatcaagacagtcagaccaggcagggtggaggcgacggtgtctgggaagcaggggaagcaggctgagccagggcttggagggaaggagcaggggtggtcccagtgcccatctctgcatggccagggccacccgggccactctgagtccctgcaggaagagccgggcagggactcacggtccagggagcctgcttctgggctgggggaggaggtctgctctggagggccaggcacgggtggggcaggtcctgaggtgggggttccgcctctgagcctgatgtcagcaggagatacttgtcctccccaccatttcctgggctgactctcggggttgtctctacggccgggtgatatgaggcctacacagcgaacataggccccaggcagctgcctgctgggtgtgtacgtggcggttcctcgggtacacgaactagcaggagtgactgtggaggcagccaggacgtgtgtgcgtgtgtgtgtgtgtgtctgtgtatgtgtatatgtgtgtgtgtgtctatgtgtatgtgtatatgtgtgtttatgtgtgtatatatgtgtgtatgtgtatgtgtacatgtgtgtatatgtgcgtccctgggcgcgtggatgcgccctcccctcccctcccctctcctccatcctgtctgcctcctccatacctagccaggggctggtacgcagggagtcccacgcctgctggctgaagggtggggcttgtgcttccgcccatgggcagctttgccagcgcaaggagtttctcacctgcagcggcccccgtgcatgaacgctgacgcctgtgacaccacggtttgtgctcaatggatgcctgatgccctggagagggaatggcttcttggggacagcaaattagcctgtgagtcagcttcttgagggggcatgtggggttctcctgctcccaaatctgcaccttctggtgatgtgcacggcgcagccctagccccagaccgtctgcctgtgcccgttcccaggtgcctgctgtttcgggcctcttgactgtagacctggagccgctgctcacacttgcgaagacaatggaaggccaatccccacccccacccctgctcttctggccatgctaggaatggtcataaggtgtgatattttgaaaacatgagctgtatgtccaagagtgtggcccggcccgctacactggctgtctggcgccctggctgctgtattttggtgactgagcctttttagcttgcagagcatgtcacttccaagatgttttggactgaaaaaccagcatgcagaggcctattcttatcagctatccagggacaccggctgtgcctggggggcctggatgggggtcccagactctgtcccctctgtgacctaggactgacacactcatgacctgcctcacccattcacatggcccagctctcgtccacctttcttttttttttctgtttttgagacaaggtctcaatcggttgcccaggctggagtgcagtggtgaaatcactgtagcctcaacctcctgggctcaagtggtcctcccacctcagcctcctgagtagctggggaccacaggcatgtgccaccaggactaattttttttgttgtgttttttgagacagagtctcgctctgtcgcccaggctggagtgcagtggtgcgatctcggctcactgcaacctccacctcctgggttcaagagattctcctgcctcatcctcctgagtagctgggactacaggtgcgtgccaccagaccaagctaatttttgtatttttagtagagatggggtttcaccatgttggctaggctggtcttgaactcctgaccttgtgatccgcccgcctcggcctcccaaagtgctgggattacaggcgtgagccaccgctcccggcacagggactaattttttttttttttttttttttgagacggagtcttgctctgtcacccaggctggagtgcagtggcacaatcttggctcactacaagctccgcctcccgggttcccgccattctcctgcctcagcctcccaagtagctgggactacaggcgcccaccaccacgcccggctaatttttttagtagagatggggtttcaccgtgttagccaggatggtctcgatctcctgacctctggtgatctgcccgccttggcctcccaaagtgctgggattacaggcgtgagccagcgcgcccagcccacaaggactaatttttttatcttttgtagagagagggtcttgctatattgcccaggctgctcaagtgatctgcccgtctcagcctcccaaagtggtgggattacagacaggttcaagccactgtgcctggccttatctacctttcaactcccttcacactgctgtccctgccccggaaacattggccacaggggctagtcctctgttgaccccctcagccaggctccaggtccagccacccgctgtctgcagcacacaccttcccatcaccctgggagggctgcgtggcacccatggtgtgagagaggaggctgcgcctgagaggtgcgttagtgagcctgacacacagcctgtgtgtggcctggagaccactagttctggctctgaagtccactggggctctgggacctcggtgggcccttgagtccgtgtggcttgacccttggttgtttggggcctgcttcccagctgccagcagaactggggctcccgtcctcactcctcctgcagctcagctccagagctccaggggcctgggccctctgcccagctcatcctctgctcccagtaggcaacccccccacccttgagagggggttgccctatgcctgtccctctggggtctgcttgcctattcctgtcccagcacctgccgggtggtcaggtggagtggcttcaggggcaaggcccccgctatttttagcactttcggctcctgtaaacacctctcccagcctctctggccctggaagcctctcctccccagcacagccgggaccgcggctgtcacacgcccctgcaaggcctggaggagggtccctgaaacttcgtgcagcacccgccctctcctgcagcagagattggcgctgcgttcccagccccttcagctgcttctccccagagccaggtgcttgggtccagccgtgcggtgtggaccaggccatgcttggggacgacaatcgaggcaagtcctacctgcaggaatcggtgtgctgagaagcagggctttgcacacaagctatatgtgttgccacacagccaccactgccatcctaggggagcagcgggccactgccaggcatcccacacctccctgcgtgacagcagcctggccagctttgagcagccctgagcctgtgcggggacagctcttggtgttcctgttttgcattaccttttcactgtttgttgagacagcccaggcagcatcttgggggctaatcccgggggctgagtcgctggagaggggtcaaggggagtggcctgtggctgccattagtgcctgtccctgtggcctcggtccccgcggcctcggtccctgcagccgcagtggcgcctgcatggagggggccccctaatcatggtgcctcggctgtggaatgttctgggagctagtcagaacggacatggctgccgcagctgaccctcccgcctggcgaactctttctggctaattgttctgtttgtttgcccagagcaggtgggggcagggcctcttccatccattatcggctcacatggtgccagggaggcaccgtgtgcacacaggctcagcattttggttttgcttgaattagcaagaagcagcagggagtggggtttgagatatctgaatatttgtggctgtgcaaacccagaatcaacaaataataatcagcaaatcaagaaaaattacatcaacaatcaacaaataataatacaccaggaatccactggttatgagcgcagctcagcacagcgacatttctcagctcgttgatgtcccttcctcggtgcgtgctgagtcgttcctgtgtgccgaggccggtgcggggtgctggggcccagtcccctgggttcacagcccaggctgtgacagaggtgggttctaaagactcccgagctggtgtgcagtctcttcttacacccttgtccagatggccgcggggcccatcctgcgccctaaagagcagagtcagggccaggagctgggcacaggcggtttttctgggagatgttcccagggggtctcctggggagaggctggctggggccactgcaggttgggggatggagctggtcacctctgtgggaacccagggctcagtccccccagggaccatatgaaatcatatgtcatgcgcctgaggacagccggcagatggtggggggctgggtgtttatccaggaactcttgacccagggttgagggttgccttgggggtgacaacactccagcactttccactgcaaagggtccttgctggctgcagagaaaccagggagcttgggggtcagttccacccctgggctggtgtgggcctgacacaggacctggccccgtcggcactgtctgtcatggctgcgcagaaattggggtgcgggacagggaggcggagagcagtcagacctgggctcagggccagccccgcgagttcttcaaaccccatggcatctggaaaaggaggcaacagggatcgggcctcggtggctgatgtgacaggtctgcgggcataagaggcccagggagcaaaggcagcacaacccttccagcacccagaacggcatggcggggcctgcagacacaacctttccagcacccagagcagtgtggcggggcctgcagagagcctcctgcgtggcctgtgcagggtgcagcgcccgccggcaaagcctgcacgatggggacagagccccctctggacaggggaagagaagtccgggctggggatggtcagggggtgaggcctgaggcccctggagcaagttacagggttgtaacaggaagctagggaagtttgcactgtgccacgcgagtgcttgctagggcgagctcatgtcctggaactgcaccctggtgctgcgggaggcgggaggcagagggcacagttttgtttgtttgtttgtttgtttgtttttcgagatggagacttgctctgttgcccagtctggagtgcagtggcacaatctcggctcactgcaagctctgcctcccaggctcaagcgattctcctgcctcagcctcccgagtagctgggattacaggcgcctgccaccatgcctggctaatttttgtgatttttagtagagacggcatttcgccatgttgtccaggctggtcttgaactcctgaccccaggtgatccggaaggcacagttttgcctgtggttgctggaggtccccgagggtggctcagatgccagcactggcccagagctgtgtggccctgggcaagttacttctcctcgctgggcctcagggttcccatctctaaaacagagatgatgggccctgccccgtggggctgtagtgaggattcagcaaaatcaccatggggtgtgtgtcccacaggcaggagtgagcatggggtgggggcagcctgtccagggaagccaataacaaccatcatcacaaggcaccgcaccgctgtgcttcccttaggaccctcgtgcagggctcccgtgtccttccacatccccttcccccttccctgcgagagcctgaatcctgggaagggccgcctgggcaggcctaggccctccttgtacagaggtgggaactggggtgggagggagctggggtgcccctaaggggccagtgggtgggaggcggggatgaacacacatccagggcagggggagcaacccctcttaatccagggccaacacagtgagcatgcatggctttttcccccaatttaaaatgaaaataactttattgagacccacggacaaaacttctgtcctcgtaatactgatttcctgagcttatttctcagcactggctgctgggtcacagttctcctgaggtgtgactgagcatctggtgggcactgagctgttctgggcccgggctgcaacgtggctgtgggctgcttggcctgtgcgggctagacaccaaggcagcctgggaggcccgctggagtgggaggcccgctggagtgggaggcccgctggagtgggaggccctgattccttccccaaaaacctcgggctcttggcagagtcgtttcctccctgattcgaccagggttgagtgccatggcctcagcaccagagggactcttgcactggactaggtccacggggaccctccctgcccccgccctgccctgggtcctccctgggcccccatctgctccactgcagggcaccccttcccttcctcctagtctttcccagatgcctgatgactgcctcaccccctcacttcctaggaacagtccacctgctgcgtgaggactctggccccgcacgccaggggaatgactttgtctgaggtcacctggaacctcccactcaacaaatgcagctcgggccctaccggcccccatggccctgaggagggaattaaaatggggcactcccgtcctcaggatgctttgctccatgtgccagaaggcagccgtgacatactgattagttacaacacaggtcttttactatacacaggctaagatgtctgccctgtgcagtgtcccacctgtgtaaccttacaaggctgccccttgtgcagtgcaccacctgtgtaaccttacaaggctgccctttgcagtcctcctcctgctcttccttgtaagtgttgaagcagttgctcattaacggtgcaattcggatcgtatcagtgcatgtttgtcacttgagatgtgcaaagatccctacgctgtgctcacccagtgccctgcctggcaccaagtaggacaccaataactgtagaatgagcaacattgaaatgtaaatgagacttttttttttttgagacaaggtcttgctatgtcacccaggctggagtgcagtggcgtgatcactgcaaccttgacgtcctgttctcaagagatcctcctgcctcagcctcccgagtagctgaaactaggcacacgccaccacacctggctaattttcatattatttgtagagacggggttttgccatgttacccaggctggtcttgaactcctggactcaagtgttcactcgcttcagcctccagaagtgctgggattatgggtgtgagccactgtacccagcactcgaataagactcttgttaagagatgtttggaaccaaccccaccagggtgaatggaagacataatatctatctatgcctcagaatgtgcaggaaagagaacactgaattgattccgccagcccagactttcttctcttctctctgttgtccatcacaacaacctcaccccacaagacatctccactctcaccgcaagacagcaatggccacaaagggacccacttggaggaccttggcaggatactccccagacatgctggctgagtcctgctccaaactccggcttttggaggtgatgagctcactgtcgtccagcggggccaagttccccatcctaagtatagatgaagttgcattcttggaatatatataaatccttattttgggatgggcctattggtgtcagcgtctgatgtctgtgtgatttttttttgacctgcgtatcagcaggatggtgacacaccaggaaggtcgtaaactggtccgtgtcactgtgaacaacactggcctaagagaggaagaaaatgcatttggaaagcccagcacttggaaatccatctggtggcggggagcatggaaaggatctggtggccccgaagagtcactcaaggacacaacggagccaaacaccctttttcatttatttggataggtggaatttagttttaattatttaagagaatacttcatgagatattttcaaagagaaatgggatcttaataatctggggctcattacactcctaggccatgaaatctttatacatctctgctggaggtgcagagcagcagccgggcctggaggactgtgaacttggagcgtgagtgagcagaaggtggtggctgtgctgtgttagaggcttcatttccttgtctggggtcctgagttcaagggtgaggccacttcccaggtgaagtcacgggaaggagcaattccaacaatggccattgacaatgaggagaacggaggcaggctggacacagtcaccagactgcgagagccggcctgaggagacttggaaactgtcctccgccaacctggctgaatttcactcttactaaagttaaccccactcgaagactggggaattccagcacctcaggggagaggctgagttatttttgcaaccccaaattaaatgatgcatggtcgctggctgtgcatgccacggggcttgatttccattcccctgattcactcttccctcctccagggcgctcaggctcatggaaactgagggaagctcagggccctgacgacccaccaggccctggccaggacactgcatcctgctggaaaggaatgccccgtgaggggctcacggtggatttttaatccctgttcaggttccctgccctcacccgaaaggcccccacccttgagctcccccggcagccctgcatctctctggggtcttcccaggatgtgctacagaagccccaagctgcacacgacccagctcctcacaggcctttctcccagacccactctccttaggccccctgccctgggtgtctgggccagccagaccgcttgcagcctcagcaacccccaacagccagctgatcatcaaatcctgtcaatgacagatcctgagcccacctcagaccaacccctatgacccacttgccagttggagtcctggcctctactcagacccttgacatcactgtcctccggtctgactggtggccacagtggccacccactctgcctgcgcctgccttggtccacactaccaggagtttccttcctgaagaggatccaaggatcccatcacacatctcagcagcctttgcctggacccctccagataggattcagacctgcccctgacctccctactggccctctgtgtcctgagcacatggcaccctggtatctctctgccacagcccatcttgggtctgctgcctgaagacccctcctctcctcccgagcatggagggccctgggtgatcttaagaggcggcggaagcattgcctcctttcagagccttagcaacttgatggacgttatggaataaatgaatgagttcttctccaaaagagggagcaggggttctgtgttccttctgtccaccatcatcacggaatcagagcacatctgagatggggggacacagcaatcctttgctcctcttcattgattacagggaaactgaggcagaggtggagccagcccctggcctcctgactcccaggacaggccagaggctacgagaccacagcctcccgaaggggactcccaaactgcaagaccggaccctgggctccccatggctggagcaaatgcctctgtatgtcctccctctggaaattcctccccgagggaccctccggagagaaggatgtgacactaactcaggactctcgagggttcttggggcacctttgagaagagtccaaggcactaaaatagactgggttcccaggagtaaacaaccaaaaggcttagttagactcctacttggaaagtatgcctacctgtatccctatgctgcttaaacaccccacctcagcagaaccccgctaggcactggggcccgggttccctgcatctcgcccactgtgtcggctaagaccatttcagctgcaagtatgaaacctgacacaaatggcttgcgtgataaggaaagtagtggccttttccaaggaaggactcttggctctaggctcaccagtttggccccttggtggcatctgcctccctgcctccctccctccctccctccctccttccttcctttcttcctttcctccctccctccctccttccttatttcttctttcttcttccttcctttctttcttccggcagagtctttctctgttgcccaggctggaatgcagtggtgcaatctgagctcactgcaacctccacctcccgggttcaagcaattctcccatctcagcctcctgagtaggtgggattacaagggtgagacaccatgcccggctaatttttgtatttttagtagagacggagttctgccatgttggccaggctggtctcgaactcctgaactcaagtgatccacccgccccagcctcccaaagtgctgggattacaggcgtgagccaccacatctggctggctcttggtggcatcttgaaggccattttctcaccctttatctctgccaagctcagtagataggattctgtgtgtcttcttttgacccaaccatcagcagcagcagggaaggcatctttgcctctgtcttttctttcttttttttttttttagatggagtcttgctctgtctaccaggctggagtgcagtggcgcgatctcggctcactgcaagctctgcctcctgggttcacgccattctcctgcctcagcctcccgagtagctgggactacaggcacacaccaccacgtccagataattttttgtatttttagtagagacggggtttcaccgtgttagccaggatggtctcgatctcctgacctcgtgatccgcccgcctcggcctcccaaagtgctgggattacgggcgtgaaccacagcacccggccttgcctctgtcttcttatcagccaagaagcctttcccagcattcctcaatagccacccctcacatctcattggctaggattgggtcacatgccccaggctaagccaatcattgtctaggagaatcattggcttagccaatcagagcctatgcctgaggcacacagggcaatgcctagaccacaggacaaaattgggctttgtcagcaaggaaggaggggtggctgttgggtggcctgtgaggctgtcacccatgtcccctcgcttgttctgacaaaggttttcataaaagagccacttctagcctgtcgtggtgggaccctcagatgtccctgtgccctccagcgtctgggcaacctgaggttctggtaggaggagaaggctactttgtagaagtctggagggcctggaagaagacatctctgcccagacagtccatttagtgtagctcgggccaccccttgccatcccgtgtctagcaggtggcctggtgagtgtggactcgtcaggagccgggcctctcttcctgctatcgccctcagtccagccgtgagctcagccaccacctcaccagtgcacacatcggccagacagccaccagcattgcctgccttgggtgccatgggggtttggcctgaactcttcaccaagcgcggctcacgaaggagctcacttcatcctcacaccagccccaggcgttgctgacatccagagctggggaaagggcaggacagaggttgaaggaagtcacccagagtcccacagctggaacgtgggggagctgggattctaacccagggctcacactgtcgcccacacccatccaggtgaaagtttgttttaaaaattacatataattcacatgccatgaaattcactacttttaagtgtacaatttagtggttatttacaaggttgtacaactaccatcataatcaattttagaacaagttcatcaccccaaaacgaaaccatgcacttcttagcagtcaccccttcctccccgcagccagcccctgtaaaccacgaatctactttttgtctccagggacttgcctattctggacatttcacataatgtgattttatggcatgtggtcctgggtgcatggaaaatcttccttgacttcgcataatgtttcatccttggtgtggcctatgtcagtgcattattcttttttttcgttttttttttttttttttttttttgagatggagtcttgctttgtcgcccaggctggagtgcagtggcacaatcttggctcactgcaagctccacctcccaggttcacgccattctcctgcctcagcctcccaagtagctgggactacaggtgcccgccaccacgcccggctgattttttgtatttttagtagagatggggtttcaccgtgttagttaggatggtctcaatctcctgacctcgtgatccgcctgcctcggcctcccaaagtgctgggattacaggcgtgagccaccgcgcccggcctctttattcttgttattgccaaataatatccccctgtgtgagaagtccacattgtgtttatttggtcatcagtggatggacatttggattgcttctacgccctggctcttgtgagtaaccctgatgtaaatatgtgtgtacatgttttgttttgttttgagacagagtcttgctctgtcgcccaggctggagtgcagtggcacaatctcagctcactgcaacctctgtctcccaggttcaaacgattctcctgcctcagcctcccaagtagctgggactacaggcacccgccaccactcccagctaatttttgtatttttagtagagacggagtttcagcatgttggccaggttggtctccatctcctgacctcgtgatctgcccacttcagcctcccaaagtgctgggattacaggcgtgagccaccgtgcccgaccgtgtgtacatgttttcgtgtggacaggtgtttgcattcttctagggcaggtgcccgggagtgggatctctgggtggaagtcattttgacaaaatgaaagcgcatctttatttaagaggctattgagtggcatcagagtgtcctgagcactggagagggaggtgggagttggaactctgatctgggctgtactgtgtggtgactataggaccttggtcaaaggccttctctgagttggtcacaatgacaagggggcaggagtggacaggcccagcccttagtggatactcgcatcccccagcccctggggaaggagctaaggtttttctgacacctgtgctgggagagatgatgatacccatctagagggcagagaaggaacaggacgtgggcctgagccctggctccctgccagagccttctgctgctcagagccaggaagacagcattttcctgctgtaatcgccaccaattttcatttgcacttgaatgtctaccccgttttactctattgtatctccttagacttgaaagtaaaccttagctcattctaatgaaagccatgcaaagctcagccagaaatttaatcgtatttactaagaagctaataaatatttactacaaaattcattgctccgtaaaattgaagacaacactttctgcatgctttttcagctgtgaggccaggctggggaagagggggagacagtctgggaaggagagaggaaggatccgacttgtttccttgttagagctaaactgtggtcttccctccaatgttttctgcaatgggaacccatcacttgccatgactttgatctgagcttgatcgttttattcagaaggaaagctttcctacaagcaattcatttccgttgcatttccaaaccagatctatttgattatgcatgggaagcttacaacattttccactgagacggtttttgaattaactgaaaacttagctgtttcataatttctgaattgtagatttttggctccccttcttggtctcataactccatcgatgggtctttttaaatctgaaatttgccataggctgagtcctcaaagaaagatatatacccttgacatttgaaagaaattaatggaaaatcactaaatcccttcaaatgctacatcgaaatgtagttacaactctttcctcaggcccagtgaggattgaatcatagcaaaatcttcatgtttaatattgaaattttatccaggagaccccccccaaaaaaatgccttgcaacgggcagctcagcatttcccagacctgctgggagcgctctctggctctaacttggagctgtggcaactggaagatgaacccgtgaacctggcttttcccaaactgcaagtctaaggctccagagaagtcagagccccaagggctaaagcatgagccatggttgggggttctctggaaacacaccaacagctgcttcccatttgcctccagaatcttcaggagctcagagcctctcagtgtgtgtgtcacacctgctcacgtgccgttggctgaagcaagtgacatggctgggcccaaacggaaggagtggggagcagatcctctccgtagaaggaacaaagtcagatgccaaggggcacgggcgcagagataggaggacggtgcaccaccctgcagtccgcactgagccctgccagcaccacattcatgggctgctgcacccattccctaaccgtggtgagtgcgggctgttgacagcacgcccgcctccttttcagagcacggccttggctgacaggagccacacatcctggctgtgctcttcctcactgcctgggagtcacagccgatggctggccgggccccctttcttcaaggcggggcaaagcagtggtgtgggctgtggtccagagagcacctgacttgagcctacacccttgctcggctctttccccttccccgtgccgctgtcttccctccctcccaggcgtttattgaagagccttccctcaataagccacgcgccctgaatccctgctccagctccacttcccgggacctccagggccaaggcggtgctttccaagggtggtccatggtgtttcctgcccagcacgcttttcgacactgcggtctgacgctccttctgagataggggaggtctgtgtcccctccccttgagtctgggcaggcaggtgacttgcttgtagccagtggggtatggcagaagtgacactatgtgacgtccgatggtggtcgtcagtgtggcacaggaacacctgctctcaaagctgccagactgcctgcctgctgcgaggaggccgggggcacccctgtgggcacacgcctggccagccccacactagtcaactccagccgttgtccgaaggcaactgcaggacagactccagctaaaccttgcccgagttcctgacccccagaaatctggagaaaataaaaaaaagatcgttgttatttaagccactaggttttgtttgtttgttttgtgtttgtttttttttttttttgagacggggtttcgctcttgttgcccaggctggagtgcaatggcacgatcttggctcactgcaaccgccacctccccggttcaagtgattctcctgcctcagcctcccgagtagctgggattacaggcatgtgccaccatgcccggctaattttgtatttttagtagagatggggtttctccatgttggtcaggctggtttcaaactcccgacctcaggtgatccacccgcctcggcctcccaaagtgctgggattacaggcgtgagccaccgctcctggctgaatggtcttttttctctgttggaaaccctggaagcctgcccatttccagagggcctgaggtgtctctgggtctcctctcagacttctgcatctccaacctgctggagcaggcccacaccctgggctgtgtgtctctgaaagaggagctggagtttcaaggactaggagagtggggaggggccaggaaacacgtggccctgcagtcagagctctcaggagttgggattctgtgtagagatgttggtgtttattcccagccctcaggggctgcccactcttcagtctttggggggaggctgaggatggtgagcaggttgggggaggaagggggaagcatgagcagggtcggggactggtggggaaggaatagagtggtagggaatggcaggcatggggggaattgcaagggggttgtagggagaataagggaggatggtgggggaactggttgggggaatgggggtagaataggaggatggggagggatgggggaaatgctgggggggaatggtggcaggtataaggggatgggaggggtgggtagagtcagggaatggcttggaggaaattccagcacttttgaaattttcccaacttcaatgcatctaaatgatgctactggattttgcctcgttatgaaaagcattagaagttgtatgtttagggccaggcgcggtggctcatgcctgtaatcccagcactttgggaggccgaggtgggcgtattacaatgtcaggagatcaagaccatcctggctaacacagtgaaaccccgtctctactaaaaataaaaaaattagccgggtgtggtggcgggcgcctgtagtcccagctactcgggaggctgaggcaggagaatggtgtgaacccgggaggcagagcttgcagtgagccgagattgtgccacggcactccagcctgggcgacagagcgagactctgtctcaaaaaaaaaaaaaaaaaaaaaaaaaaaaaagttgtatgtttaggctgattttttattattattattattcctgaccaaatgtcagaaattctattgcatttttagggtttcaggtcctttgactacccactggcagctggacacccattcaagggcaaaaaaccccacaacccacagttctgaaaacaacgtcagcgaattcatggctgcccctcttcagagtccacgcagagggttatgaagcctgggtgcagtgaagttaaagaggtggggaggaaagggggccaccggctcacatgtgtggggttcacaggagggcagtggcaatgacagacccccagcccggctgggcaactttgcagggtttacagtttaacaggctcagaaaagaccccgttcttcaactgtacagtggacggagtgaacgaacgaattttttttttttttgagacggagtctcgctctgtcgcccaggctggagtgcggtggcgccatctcggctcactgcaagctccgcctcccgggttcacgccattctcctgcctcagcctcccgagtagctgggactacaggcgcccgccaccatgcccggctaattttttgtatttttagtggagatggggtttcgccgtgttagccaggatggtctcaatctcctgccctcgtgatccgccggccgtggcctcccaaagtgctgggattacaggcgtgagccactgcgcccgcccacgaacgaatatttcaaagacacacagcagacgttactcttgatgggtcccagagcaagctcgattcttactcatccttaagaatggtgaaaaaaaaatggaatgcaggctgtggacaaactggagaatttttctttaatcctatcctttttttttttgttaattttttttgagacggaggctcactctgttgcccaggctggagtgcagtggcatgatctcagctcactgcaagctccgcctcccaggttcaagcgattctcctgcctcagcctcccaagtagctgggactacgggtgcctgccaccatgcctggctaatttttgtagggacagggtttcatcatgttggtcaggctggtctcaaactcctgacttcaagtgatctgtcctcctcagccttccaaagtgctgggattacaggcatgagccaccttgcccggcctctttaaccctatcctaacttttgttttcttttgggaatcaggagatgtcacatttacccaaatgagtgctaggaagaggcatccaagttccacttcctaattaccctgggaacttgagacagcacacgcgtattcaaatcatttccccagggaggaccaaggcagggggaggcccggggatgaatgtcatcctttctgggggtgacctggaagtggctgctcagagaacttctgttctggggtgttggctgcacagttccggcatttgtagttgcagaatgaggtgccctagtagaagagcaaaatccccaaacgaaagttagagcatccgattttggttccttaaccatctgcagggaaattttgtagtttgccacatactcaaaaagaaacagcaagggaggaaaggcgatttcccgtgaccaagccgtcagggacagccactccaggcttcctcctgagtgctcaagggcccaacctggcagggccttaccctcctccagcagcttcctggggtggcctcacgcgagcctggtgactgactcttaaacagactggtgcctacatgataccccaaaagaggggatgtgtgtcaccccagaggcataggaatgagcccaagacacctgggccgggggccacagggtcggcagagagcccaggtggatgctcactccagttcttggtccctttaatcatggcctaaggctccctatgcttctggaaggagaccttagcttccggaaggatagctggtgttcagcaaactcttgttaaactgatgaagcagggttatttccatagcttgctaattccaaagagagtaattatttacttaaagaagctcttaggccgggcgcggtggctcacgcctgtaatcccagcactttgggaggccgaggagggcgtatcataaggtcaggagatcgagaccatcctggctaacacagtgaaaccccgtctctactaaaaataagaaaattagccgggtgtggtggtgggcgcttgtattcccagctactcgggagactgaggcaggagaacagcgtgaacccaggaggcagagcttgcagtgagccgagatagcgccactgcattccagcctgggcgacagagcgagactccaactcaaaaaaaaaaaaaagcagctcttagactgtcatttcaatggtgaatgccccctgtgacatgagttgatttgggtacctttagaaaatagtggaggaagctgggtgcagtggctcccgcctgtaatcctagcactctgggaggccgaggtgggcagattggttaagcccagaagttcgagaccagcctgggcaacatggtaaaaccccatctctacaaaaaaaatacaaaaattagccaggtgtggtggcacacggccacctgtagtctcagctactcgataggctgagatgggaggatcggctgagcttaggaggtcgaggctgcagtgggtcacgatcgtgccactatactccagtctgagtgacgatgaggccccatcaaaaaaaaaaaaaaaaaaaaaaaaaaaaagaggccgggcgcggtggctcattcctgtaatcccagcactttgggaggccaaggcgggtgatcacgaggtcaggagttcaagaccagcctggccaagatggtgaatccctgtctttactaaaaatacaaaaaattagccgggcatggtggcaggcgcctgtaatcccagctactcaggaggctgaggcaaagaattgcttgaacctgggaggcagaggttgcagtgagccaagattgcgccactgcactcccgccttggcgacagagtgagactctgtcaaggaaagaaagaaagaagaaaggaaggaaggaaggaaggaagaaagaaagagaaaggaagggaagggaaaagaaagaaaagaaaagaaaaaaaaaaagagggaaattgaaagttggtagttatggaaaatcacctacattgcaatcatgcacgggatttaacgtcttaaaacaactaatttaccacagaggtgcaatgagaccccgaatttgtgaatccactgattttttaaattcttgctacccaagacagagaacacaggggatctctgtgttatggggctcatcagacccctttatttagccttcagatgggaagccccaccccaccctgccctggaagagccgccttcttggggagttgctttcatggacccagctccagggaagatgggtggcctggattccttcattgctactcacccaactcagccctccaggacctctcaaggccttacggcacccccgagtttggaaattctacttgtaattgggtttattaattagagttcatgcttcaggtgaataagacacaaatacaattgggctgccccacacataacctgggtaagaagaacaaagtcagagttggtcattgaaacaactcccagagacaaacagcagcaggggttgagagtggattcttttttggggtaggggcaggggacagggtcttgctctgtcacccaggctggaattcagtggtgcagtcatgctcactacagcttcaatctcccaggctcaagcgatcctcccacctcggcctcctgagtagctgagatcacaggcacacgtcaccatggctggctaatttttaaattttttatagagatggggtctcattatgttgtccaagctggtctcaaactcttgggctcaagtgatcctcctgctttggcctcccaaattgctggagttacaggcaaaagccgccgctcctacacaaacacatacacacacacacacacacattttatatatatataatgtatatatatagagagagcgccaggtttttgattggcctggactgggtggaggtctggccttgagtttctttcatgttcacacttggtgaggccagggggtggccaaagaccctcagtctttttctttttcttttcttaattttgtttttgagacagggtctcagtctgtcacccaggctggagtgcagtggtgcagccttggctcactgtagctatgaccatctgggctcaagtgatcctcccaccttggcttcccaagtagctgggactacaggcagacaccaccatgtccagctatttatttatttttgatattttgtaaagacagtctcattatattgcccaggctaatctcgaactcttggactcaagcgctcctcctgcctcagcttcccaaagtgctgggattataggcatgagccatggcccttggccagactccaattttcagccccgcaaatgcacttcaaattcacatattaaataaaggaatcttgcttattatggcaatgagaattcaagacaggttcctccaactcttccagacagatggccctaccataagcttctccagtgtggacatgccagagccagcctcagctctgagcccagccccgggccacagtcctgtgtgggcagttacttattatgaagcatgacacagtgaaactggaggcgtatggatgggacagatgagacttggggtggatggcccacttactcattcactcattcattcattcacttagttgaatgttctgagggctgcccagggcttcctaccatggagagtgagcatggtctccaccctctccaggctgtgggcagccctggggagagggaaccagccaggaggaccaaagcctctggcagagaactgggtggcgagaggaggcctggcattctctgctcaggacagttcaggagcgcaagtgagttgacccatgatcatttttattgactgattgactgctttagagacagagtctcgctctgtcgcccaggctggagtgtagtggtgcaatctgggctcactgcaacctctgcctcctgggtccaagcgattttcctgcctcagcctcccaaatagctgggactacaggtgtgcgtcaacacgcctgtttaatgtttgtatttttagtagacactgggtttcaccatgttggccaggctggtctcaaactcctgacctcaagtgatccgcccgcctcgccctcccaaagtgctgggactacaggcgtgagccaccgtgcctggcccccagtgttattttaattatgtgggggtagatatcatttttacccatggcaactgatcatggagcccagagttaaaccacctttcacatactgaggaaagacgggctgatccttccacagtattacagtgacagcttccaaaagaccgccctgtgcctttcttctggattatcatggcaccccccaggacacgttggcctcgttgtcctcaccagcactggctgtcttctcgaagctcccttggggtagggcaggctaacttatttccgctgtacaaaaggggaaaccctgggtcaggaggtacagaagtgccttcctaagagcatatggttagtcatgagttgagttctgctttttcgatttctggtggagaattctcttgctctagtgattcctcatgggttcatttttcctagggagctcatcaccattattttttggggggcctcttggcaagaagagctgggggcttgtcctctggtgtcctccatgctccaggcacgaagccactgtgccaggccaggggcccatttgggggtgaatatcacgggtttatcatgaatttgcctgaagttcaacagatatttattggctggaagaaagtggagattaactagaaggttacttttgatagaatacaagctgtcaatcaaactttacagtggccgccccctctcagagtaaaaccaaagtcctgtcaggacccaaaaagccatggatgtccggctcccgacacccctaccccaccctggtgtctatccttcgcgcctctctccccgcgcacaggctgcaggcacactggcctcgaggagtgctcaccaatttcagggcctctggccaggctgttccctccgcctgggcgctctccccactggtcctgcgggtctgcccccttctctcaggtctacattcacagggtacctcctccactgccctccctggcctcttggaaatgcactctttgtccagaatcacccctcttggctctgactggaaggaagaggggagaaggcacacagatacctggggaggagtgttctgggcagagggaacagcaggtgccagggctgtgaggagcgaatcagcgtgggtgcactaagacttcctggaggccagtgtgctggagcaggtgatcgaggggaagcacagggcctgaggtgaccatcacggtccccatggctcttccggggactccaccactgcgagcagctcagccaaagctgccctttgggaacagcagtgacgtggccagagccaccttggcacacagaccatgctccgtgagtgccacgtgccgttttctctccactggttccgaagtggagtttttaaaaaaggactagagatgtttctatggcatttggaattgacattgaacaaacctaatatgtatccatttaaaaactagatcagcactttgagaggccgacgcaggcggatcactggggtcaggagctcgagaccagcctggccagcatggtgaaaccccgtctctattaaaaatacaaaaattagccaggcgtggtggcaggcatctgtaatcccagctacttgggaggctgaggcaggagaatcacttgaacccaggaggtggaggctgcagtaagccaagatcacaccactgcactccagcctgggtgacagagggagactccgtctaaacaacaacaacatcaagccaggcacagtggctcacacctgtaattctagcactttgggaggcagaggcgggcagatcatttgaagccaggagttcgagatcaccctgaccaccatggcaaaatcccccatctctactaaaaaaaaaaaaaaataggtgtggtggcgcacatgggaggtggaggttgcagtgagccaagatcgtgccactgcactccagcctgggaaacagagtgagaccctgtctcaaataaacaaaccagatcaataggccctgcctattgggcacccaccatcacttctgtggcagccaccagatgaagggcgatgccccatcgcccccttgctctgcctcaggggcggaggcacctaatggtttccagtgtttggtgttattcctcttgaagagtcccagatgtggggtcactgggttgagagggattcgcctctgttttgagcactcaggacgcttgtgttatcagttgctgtccacagctgcgtgccgattttcactcccccagctcccacttgctggaaccgagagtcaactgtggtctgttcatgacacaagataatgtcccatggtggttcaaatttgcctgatgttcaacagatgtttattggctggaagaaagtgaagatcaaatatgaggtagttttgatagaatacaagctgtcaatcaaactttacagtgggtgccccatctcagactaaagtcctgtcaggacccaaaaggccatggatgtccggctccccatgcccctaccccaccctcgtgtctatccttcacgcctctctccctgcgcatgggctgcaggcacattggcctcgcggagtgctcaccgactacggggcctctggccgggccgttccctctgcctgggtgctctccccgctggtcctgtgggtccgcctccttctctcgggtctacattcacaggacacctcctctgccgccttccctggcctctccctccaagcctccgctctccctcccctgccactactttctctgtagctctcatagattcacgtgtggtgatctgttctatctccacccacgagaaagtaagctccgaaaggccaggcatgcagttggttttgtgctggtggacagctggggggtggggcatgcccagcaagcagctctggactgaataagcacggggaaggtgggaggggtcgcttccgtcccgcagcctgtgaccctgcagacttgtcctcagcctcgggggatgagggagggtaccgcatctgcccctgttcatggtgggatgcatagtgcaatgttgacaaattagataatttctgtacttttcaaacattttgtttcattaatccaagacttaatttggacccaataatttcccccctcctaatttccagtgtgcagggaggaccagggctcacttccttggctgttgccacatgcgacgagttgggccctccaagggcccaccaaccactggctttgctggctgagtggagcaggctgctgagggctggggctgagttgctcgggattaggttggggttgggggccacagaggggccattctgagcctgcaggtcggggacagtgatgagacagagcggtgcggcctctgagtgggattttaaggaaggcatgaggtgttcacagtgggcttcgtgagttttgcttcatcccgatcctcttcccggtctcccatgatgccttcagcagaagatgctttttcttaggagtatgatggagttggatctattttgagaaggcattaaaggtcgaggtgggccaggtgcggtggctcacgcctgtaatcccagcactttggcaggccgaggtgagtggatcacctgaggtgaggagtttgagaccagcctgaccaacatggtgaatccccgtctctactaaaaaaatacaaaaattagccaggcgtggtggcgggcacctgtaatcccagctactcaagaggctgaggcaggagaatggcctgaacctgggaggctgaggttgcagtgagccgagatcatgccattgcactccagtccgggcaacagagcgagactccgtctcaaaaataaaggaaagaaagaaaggagggaaggaaaggaaggaaggaaggaaggaaagaaggaaggaaggaaggaaggtcggtcgagatgggcgtgaggctccaggcaaagctgcctgtaggatgccagccacgtccaagattcatgttctcccaaaagatttcgggaaaatgccagagatgtgtgtgtgtgtgcgtgtgcgtgcatacaaatcccagaatgggttccctaaaatgaggatggctgggggcagtggctcacgcctgtaatcccagcactttgggaggctgagaaatgaggatcatttgagcccaagaattccagaccagcctgggcaatgtagagggaccgtctctacaaaaaaaaaaagtagttgggcatatggtgacacacatggtgacacacacttgtgttttcagctattcaggagggtgaagagggaggactgcctgagcctgggaggtcaagtctacagtgagctatgattgcaccactgcactccaacctgagtgacagagtgagaccctgtcccagaaaaaaaaaaaaagggtatcttcatctccccgagtggtccacggagaaaatcagagctggttttcttctaattgattgttattattattatttttgagacagagtctggctctgtcacccaggctggagtgtggtggcacaatcttggcccactgcaacctccgcctcccatgttcaagcgattctcctgccgcagcctcccaagtagctgggattacaggcgcgggccaccacgcccagctcattttttgtatttttagtagagacgaggtttcaccatgttagtcaggctggttttgaactcctgacctcaagtgaactgcccgcctgggcctcgcaaagtgctaggattacaggcatgagctacagtgcccggcctctgattaattatttttattttgatttttttgtagagacgagatctcatcgtgttgcccaggctggtctcaaactcctggcctcaagcgatcctcctgcctcagcctcccaaagtgcagggattacaggtgtgagccagctagcccgctagaactgtttttctgtggccggggaccccagcctctcaccttccctgtcatcactgccctctcctcccctctcgaatatcccgcgtgaggggtttgcacacccacgcccatctcgaccttccttccttctttccttccttccctcctttccttccttccctcctttctttctttcctttatttttgagacggagtctcactctgttgcccaggctggagtgcaatggcgtgatctcggctcactacaacctcagcctcccaggttcaggccattctcctgcctcagcctcttgagtagctgggattacaggtgcccgccaccatgcctggcttgctctgcctccccacccccatttcctctgcatttgtttacaagcatccctggcccgagaagggcaccagcagcttgcttctttgctggcgacctctgctgtcagccagggtctacttcaaggacaggatgggcttcccagcccagctgccccactgtgcactcacgacagagcggggtgctttggcgccacgaccaccccagctccctgaacccccttcgacatcttcagcagctctttcagtctaaaatggtgttttcaaacttcaggtcatgaatcaaaagtaagcttaaagggtaatggccaccattaaaaaataaacagaacggaaaatatcggagtgcgccgcaggtttgagatgatctgttgttacgtgtgtgtacacacacaggttatgaacaactgggttaccatgtaaaatgtattcaaaggttcagaagccacttgttggaacaattagtaaaactgtgattctgccgtgcatcagggtccgccccccgaggctgggcaccatggctcacacctgtaatcccagcactttgggaggttgaggtgggcggatcacctgaggtgaggagttcaagaccagcctggctaacatggtgaaaccctgtttctttttttttttttttttgagagggagtctcgctctttcacccaggccggactcttttgcccaggctggactgcagtggcgctatctctatctctgctcactgcaagctccgcctcccgggttcaggccattctcctccctcagcctcccgagtagctaggaccacaggcgcccgccaccgcacctggctaattttttgtatttttagaagagacggggtttcactgtgttagccaggatggtctcgatctcctgacctcgtgattcgcccgcctcggcctcccaaagtgctgggatgacaggcgtgagccaccgcgcctggctgtgaaaccccgtttctactaaaaatacaaaaaattagccaggcatggtggtgtgtgcctgtaattccagctactcaggaggctgaagcaggagaatggcttgaacctgggaggtgcaggttgcagtgagctgagatcgcgccattgcatgccagcttggacaacaagagtgaaactccgtctcaaaataaaataaaacaaaacaaatcaaaaccaaggtccccaccccccacccccaggccacgtgtagcatgtttgagtgagagaagttgccagcacccttcagcccaagttgacccacaggggccagtggtttttgtgtgggaaggcgccacctgaggcacagaccatcacattcagggagagttataagaaaacccctttcctagccccaaagcccctggcactctgccacgaataccttttccttctcactgaaagacaaacaggatggccttctgagctgttgcatgtctgtgagtcacttgagtatctgcatgcacttctccaaaaatgcagcaagcagaacatgtaatgctacatcaactcctgtgagaaatgcgtccaaagatggtgtcggtttgttgttggacgttgccatagggaacagagatctgcctttgaagtacagcgaggagagagctctccttcctgcccatcactgctgccctgtggctctaactgcaggggcgagaacacccgccaccaacccccaaagcagttgccctgcttggggcaaacttctttgtcctgtcccccttcaattccccacagcagaggatcttcagaactgctcaattggagaagaaaaaggaggaggaggggagggagagaaagggagggaataggtctcaccagcagagggctcagcctggttgtgcctgacttcattctcaatgttgctttctaatgctaggctggagcatgaaaagagccgcagaaaaccctctcatgggtctttggaccttctgccttgcttcttcttttcttttctttaattatttatttatttttatttttttgagacagggtctcgctctgttgcccagactggagtccagtggtgccatcatggctcacagcagcttcaacctcatggactcaagcgatcctcccgcctcagcctcccaaagtgctgggaccacaggcataagccaccatcctactttttttttttttttccagacagagtctcactctgtcgcccagataggagtacaatggcacaatctcagctcactgtaacctccgcctcctgggttcaagtgattctcttgcctcaacctcctgggtagctgggattacaggcacactccaccacgcccggctgatttttgtgtttttagtagagacgtggtttcaccatgttggccaggctggtctcgaactcctgacctcaggtgacttgcctgcccgcggcctcccaaagtgctgcaattacaggtgtgagccaccatgcccggtccatgtcctgcttcttttaaaacaaccaaaaatagtccagcctaggaaagggagtctttcctgattttggcaaagttaaaccaggccataggtaacacacagcataaggcaggcgttgggagtgggccccagtcgacagggtgccaggactgtgggctaagcagggctggggacatgggaggcctcagtgcctgggctatgggaagtggttgggaccctgagcctgaggtcagtaacatcccaactcctgacaggcaagaaagggcacctgaggctcccaaggggagtccaccatgggggtgggggagaccgctggagtccataggtccctgtgagggacggcgaaggcgggcctgtcacctctaaaagagctgtgcctgtggcgcagacgggggtgccactgtggcctggtgagtgtggctgtagaacaagcatctgttgggctaatggagccagagacatggtccaatgtctctgatgtccagatagacttccagcagccaggtcggactatctggggttctggaacgttccatgggtgaagctgtaggaggagatgctggacttcctgcctccactcacatgagtcactggagcaatacaagaaggcagactggccttggctactcacactggtctcagctctggggtagggctctttataagccttcttgagaagtgaaaaatgcaaagtcctttctgtcccctcaccactgacttgcaaactccagcgaaggcctcacccctcagctggcccagagcctcccagaagccctcccttcgcttcccacctcgccaggcccagccaggctgggtgctgccttggtgggcctaggtgaatcactgacacaccactgatgcctttggggcagaaggcagaggcctcgggagaaatgcgcaggccccagcggcctggtggagggtgcagggggcgcaggggcagccaggaccgccgaggacgctgggggcacgtggcaaactggctaccctgtccacccgtgagcaagacaccactccgggggcgtgggagggtccaagggagggagaaaggaaagtgccaccaaactaatgtggagccctgccctctgcatgcgaaaaggggctccacggcctgagtcaccctcagccccacctgcgtgtgcgcgagggtgcgtggcctggtacgcgtgcgcacggtgttggtgagcgtgtgtgtgcgtgtccgcttgaggggaatgtgaccgtcgtgtatgcgtccgcgacagtgcggggggccgcatatcggacccgtgcgtgtgcgtaggggtcgcgtgtggccatgggcacacgggcgtgcacgcacgggggctgcgtatgctatgctggcgtggggggtgcgggcgaggtggccgcggggaggagcggcgccagcacctctcggcccccacgcggcctgcgtggctttttgacccggaaaggcggggacgcggggacgcgcggcggcgggggcgcggcgggggcggcgcagagcgaggaggcccgcggggcgcgcggcggggacgggagggaggcggggggcgcccggggccgtccccgccccgcgccgcggcgccgccgttgctaaggccgggcgggcggccgccgggcgctagggcccttagcaacgggtcgcgggcgcgcgcggggggccggcgggcgcgtggggccggcggcgctcgcgggctcctgccgctcccacgcgcgcgggcggcgggggcggggcggcgggcgcgccggggatttccagcgcgcgagaggaagtgcctgcgcggggctgcgtgagggagcgagggagcgagggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgaggtaaggggccgcggcgggcgggcgggcctccggcgcgcggccgggcgcctccatccccgtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaacagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctcaagaactgaaaaattgggggccctacatttcatttcacaatttacttttttactacgatttgttccatgctgatttcgagcattaaaaaaaaaaaaaaattaaatggaggctatttggtggtaacttctcatgaggccattctaccaagaaagatatggcgacctgctgcttggacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagttttatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccttcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagtttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaatgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctctctctgtcgcccaggctggagtgcagtggcgcaatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccactcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggatgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagactttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaacctccacctccaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccgtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcatggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcgcctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatatgatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttacttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttttttttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagtctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaagcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaagaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctgagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctctgtcaccgtcttgaaatactttgcaattctcagcgaggggcctgccgtcgccttttccactttgcttacagttttgcctgcggcctttaacctgaagggaatcccaggggccaggctcgcaaatctgtgtcttggtccagagcagataaggcggagctctgacctcctgcccggacacgtgcccgccatctggcatggtggaaagggcgtgctggacccacaggcctggggtcagtctcagctccacgacttcgtgggactttggaatcttcgagcctcagtttcctcctctgtccgttggaaggacagcacctccttccacgccgaaacaaggtggttaatgaggagtgacaccagtgctgatgtgcaggcggctgcagggtctgggcagtgtccttctggcagctgctcgtggcagttaagggctcctgggctgtcaccgccaccatggcctgccttccatttctccaggaagttgtttgggtcaggcctggtagcaggaagccctgcatctcccccaaaattatcagatggggagaaccgctcagccctcccccactgtcctgccactcccagggtcccctgcagccaccacagcgccctgctcagtccctccccatccttcaaggcactgcatggggccacatccagaacagatgccatcggtccccacgtgtggcccactgagcagggaggagtggacctaggagcagcaccccagggtcctccctcagggtctcagggcctctcctgagggtcccttgccagcgcagcaccagccccgccctctctgcgggcccacaccacccctgccgtgccctggctggtggcagtagtggggcgctggaatcctgggactggcagcctccaccccacacacgatggggagcctgtggtaccttggctcccgggagctgccccaggacacagccttgctggtccttccgtctgggggatcccaaatcctcacacccctgtggtgggggcctgcgctccatccatctccctgggcgctcaagcccagggtcctgccgcagccttgaggacaccgggacacctatggagaccaggcagtgtgcagttgtcaccgctgaccgcaagtgtgagctgggccgggggtgggatggcgaggacagccagcgcgatgtgccgatgaatggggaatgtcagctggaggcttgagggattgcagaaactggattccttttttttttttggagacggagtttcacttgtcacccaggctggagtgcagtggcgcaatcttggctcaccacaacctctgcctcctgggttcaagcaactctcctgcctcagcctcccaagtagctgggattacaggcatgcgccaccacgcctggccaattttttgtacttttagtagagacggggtttctacctgttggtcaaactcccgaacacaggtgatccgcgtgccttggcctcccttttttttttttttttgagctggggtctctctctgtcacccaggttggagtgcagtggtgtgatctcagctcactgcagcctcaacctctcaggctcaagtgatcctcccacctcagtctcctgagttgctgggaccacaggcgcatgccaccatgccaggctaatttttgtatttttaatagagacggtttcgccatgttgcccggggtggtccggaactcctgagctcaagtgatccccccgcctcggtctcccaaagtgctgggattacaggcgtgagccacccccggcctggattcttgcaccctcctgggagtcctacaggagaggagatgggcggcaaaccccaagacctgctggactggcctgggctgagggtgctggtggggacatctgcagagctggcctcagatcatgcagcaagaaacggcgggggggaggaaggggagcttctgagctgctccccccagggcattgggcagggactccctgcccccagcctgacgtccagacctcaagggggttggagggactgagtccagccctcaggtgcacaccgggccatcacctggctccgtcctgctgtggggcagcccagatcttgcagggaattgggaaccaggggtgtcacagtctaggcctagggaaggaggaggccgtggccctcgcctgcctcccctcagctcagggggctgctctgttctggcccagatgagtgatgccggaaggggagcggtgcagagcagggaggcacacgctcagagccctccgtggccctgactctgcactgcagcagcccccacgcccaagagtcaacccagcatccaaaccagggaagagtctggactgaaagcgcaaccgtacttggtgagaggccggtaatctcgagttctggtaaggaaagcaaggcctggggcggaggctggggctcggctgctgggctggatcaggcggcacacccggctcacactgccctgcagtcctgtgggagacagcggcactcggacccgctcacaagccctgcaggacaccagtggaaccacatgggtggaagcctagaaatcagattctgaattgaagtccagggggttttctgttttctgaaaatgagtagttgcataatctaaccctaaaatcaaccatttcttgttaaaagaccagaagaaccaaagtgctgtgcaggggaggtgtccgcgccgcctatgctttttgtcttagttttttaattttcaaggtcatccttaaagcctctgccttgaccctgcagccacaggtgacttggaggctggaggccaggcctggggtctgtgtccttcaaataaatgcctcagtgccgcttgggggactcggtcctgtgccggagttactcgattagaagttaaaggtggaggggaaagacacctgtggggccatcccaacccacttcctccactcagaccacagctttgaatgggctcagtccccagggacccccaggccccagggtcagcctcgcagggcagagctcagaaccccctgcccagaccccagggagccaaaggggcccagatctgggcacagggcaggaagagggctggcacctgctgggaggggtctaggagccaggggcacagctcacatgagtgcatacccagcacctctgcttcatgtcaaagggagatgatgctggcgtccacccgagaggccacatggaaagcactcgacatggacaggacatcgcccacaggaaaaacccctgcaagggaccttggaccttggggaaggcggctgtgccctcccgggctgggccttgcaccctggcctgcagccattcggctcggaggactcccggcacccacaggcacttggctcccgccacttccctggcccctgtggcacttggggctccacagctctccgactccctgctgagggttgagccgtttgcaagcatgtgtccccatgtgtgcttgagggccgggggcacctgtgcatatggtcaagggccttctgtgcacacatggcacctgcagtgtggtcccagccgttcctcagcacccgtgggcccagctccatctcgggcggcctgcttggcgcagctctcgctggtcacctcgtgccgggtgactgctctccatcagctgtgcccgggctccacatacatagcccgggtcacatccactcacgtcctggtccagccagccttgcggggactctgcccaaggagggacagtaagggtttttgagtaccaagtcagtgaccctgactgccagcagcggctcctcttgacccggaggccggtgaacacctgacaacatttccctccatacagcgcaggggcaggggcagattaaccctccgtgcggaaggaggagtggaggtggaggcgggacagtggctggcccctggtccaagtcttgcagagccctccccatctggggtggggttgaagcaagtcactcaggggcagcttcctagctggtgctcccgagaccctcagctccccaacaccctgatgtcctcctccttcctcccattgtccatggatggagaagggaccaacggttcctccggggctgagctctcgtctcctggtgctcctgcttccctaccccccaacccccaggccagggctgcagcctgaaggggcactgggtccctgcgccctgtgagatgggcgctgccacccttgctctgcaggtgacgaatggaggcgaagtgaattgcagtgtcatatggcatttgagtcctagacagcgcccaggactggtccgaccaccgctagatgccaccaggggggctctgcctgtcccccaccccagcagacagcaggcccagccccatccaagctaggtggagacccctggtccataccctcctgggcttccctctgagttgtatccaacccacccagcaacagctgctctcagcaagcctcctggcctcacctgcactctcttccctcctctcctgcctcttgccttcctttttttgtgagacagatcttgctctctcgcccaggctggagtgctgtggcgcaagctcagctccctgcaacctctgcctcctgggttccaacaaatctcctgcctcagcctcccaagtagctgggattacaggcacccatcaccacgcccagctaatttttatatttttagtagagatggggtttcaccatgttggccacgctgatctcgaactcctgacctcaggtgatctgcctgccttggcctcccaaagtgctgggattacaggtgtgagccactgtgcccagccaccttcctttaaaaacaaaaacaaaaaaccccaaaaacctgaggtcttgctctgaggcccaggctggggtaatcgcagttcactgcagcttcaacctcctgggctcaagcaattcttcctcagcctctgcggcgccgggaccacaggcatgagccactgcaccgggtgttcttggctccctcgaagcatccctcatgttcccgtctcaaggccttggcgggctctttccctgtcttgctgatgtcccaggcccaccccaccttttccctggccctgccatgtgcaggaggcagggctgtcactcttgctgcctccacacctcaggggaggctgtgagccagcgtggccagtcagagcacagcaacctcaggctacaggaactggtgcagagttggagacaggaaccaatcagagacctcactgagaccctcctgccatggcctggtcaaggaggtggtgagtctcactctcccaagacaccttccctgccacgtggagaaggccgtgcacacggaaaccaacacaggagggccgccagccatagcggagacagacacagggaccaagagactgagacagcctctagatgctgaagcctgcgctgaagcagttgggccgtgagaggttcttcttactggaggaaactccggggctttgcatttctccacgtccctgctgaggttctgagccatttgcaagtttgtgccctcatgtgtgcctgagggccgggggcacctgtgcatatgctcaagggctttctgtgcacacatggcacctgcagtgcggtcgcagccattcctcagctcacatctttgcatgtgagtggttctggtaccgcttgtctgcccagcgccctggtgcctatctgctgcctcatgtgagctcgctgggccaccctctgactgctggacccacctccagaggccactcagggcaagagagatggatcccaataccccacccagccagccccagccccctatggtctgccaccttcaattcaacctcctcactgtggctgcagctgtgatctcatccttcctgtctcattttaatgccacctttttcaggaagcctcccctgaccaggaagccaagtggcctcactaccctctccacacagcacaatctaggaatggcctgcccaggtggagcagcagtagtcaaagaggctccattgctgccccaagtcctggccgtccagcactctggactcccctgaggccccaccatcaggagagggagccccagcctctgggccctttcagtcctggctgtggccctgagcaccaggggtgaagtttgctgagcctcacctggccctctgcatttatggtggcggtggggatggggggcagagccagacactcaggggtgaagcccaacgcagccctgtcagtcaaactgcctccttcccactgagaagcaagacaaggggcaaaacagttgtgacccccaagtatcctgtttgttcctggttgaggacatgtgagtccagcaaggggcagccaaactccaggaccgtgaggacccaccctccccgtcctaggctgggccagcaccacagagccactgagcgcagggacctctgctcaaggcgatccctccaaggtaaggggcaatgctggtggcatcagagatgtcgaggcaaggcgcccacccgggacacaaaaagaggcagagctccccccagtggcggctccttcctccccggatgcagcatatcactcatgaaagaagcaaataccaggccaagcaaaggggtgctcatggcagagtctgcagatgaggggtgggggtgcaggaaacagcaggatggcctggagggtggaaggccctggaagtctccaagactgagtagtttccctttcaccttcagtcctctgcctacatacccacctccaccatccttcctgcacccttccctagtcactcatccaccatcctgccattggaacccagtgtaaccatccaccattctcccccttccatcagctacaaccagtgtctccccaatccacaaggcacaccatccatctctccaccagtaatcccctaatgaccaattcaccaccctcccagaaactcatctccccatcatcaaatcatccaaacatcatgcacaatccatttgctgttcatctttctacctctctgcttcccaacacccacaaatccatcctccattcactcaccacccagccattccaacgtgcatgatgcagatccaagcatgcactgcagacccattcccccaacccccatcaatcatccatccatcacctagcgcacattcattcacaatttatccaccatgctctgtccacccacccattgatttatatccagtaactcctgtactcttatccatctacctactgtctctctacttactactatccattcacacatcatctaaaattcattcaccattattcatccaccatcaatccatccctccaccatttggtcttgtccaccatccatctacatccaaaatccacaactttttctcacccaccgtgcattgcaacaactatccatacatacacatctgttcaacagctacgatttctctttcacccatcaaccatccactatgcaaccatgattcattttgccaccgtccgccctttccctcgttctcctttattcaactaccatctaccatccatcaaccatccttccataatcactcttctatccatccatccaccaataacattcaccatctgtgagctgccatccatacacttacccattcaccatccacaatcaactatctactctttttttttttttttttttttttttttttaatagagtctcactctgtcgcccaggctggagtggagtggcacaatctcggctcactgcaacctctgcctcccaggttgaagcaattcggccccagcctcccaagtagttgggattacaaatgtgcaccatcacatttggctcatttttgtatttttagtagagacaaggtttcaccatgttgtccatgctggtcttgaactcctgacctcaagtgatactccatcctcagcctcccaaaatgctggggttacaggcgtgagccaccgcgcccagccaactatctgctttcatctaccatccgtcatctgtctgttgatcaactgtccttctacaaaatactatatcaacccaccacccatcatccaccattcataacgcaccacccatctatccccattcaccatccaccatcaccttccatctacctaccatccaccatccaccattcataacacaccacccatcatccccattcaccatccaccatcaccttccatccatctaccatccatcatccaccacccatctatccccattcaccatccaccatcaccttccatccatccaccatccatcatccaccatccatctatccccattcaccatccaccatcaccttccatccatccaccatccatcatccaacatccatctatccccattcaccatccaccatcaccttccatccatccaccatccatcatccaacatccatctatccccattcaccatccaccatcaccttccatccatctcccatccatcatccaccatccatctatccccattcaccatccaccatcaccttccatccatctaccatccatcatccaccatccatccccattcaccatccaccatcaccttccatccatccaccatccatcatccaacatccatctatccccattcaccatccaccatcaccttccatccatccaccatccatcatccaccattcataacgcaccacccatctatcccaattcaccatccaccatcaccttccatccatctaccactcattcattcaccattcatttatccaccgtccattcatgcatacatccaccatccatctatccaccattcatccatccaccatccactcccactatccatccatccaccatctatccatccacacattcaccatccacccatccacaacctaccatccattcatccaccattcactcatccaccatccattctccaccatccatctacccatccatccctctacccattcacatatccaccatccactcatccatcatccacaattcactcatccagcgtccattcatccatccacccattcacacatccacccatctaccatccaccatcccttcatccaccatccacccatcattcactcacccaccatccaccatccatccatccacccatctatatgtccattcacccattcgccatccactcatccaccacccaccattcatctatcatccctcatccactgtctaccatccaccattcatccatccacccattcacccatccaccatccatccatccaccatccacttatccacaatctgccatccaccattcgccattcatccatccattcatccaccacccatcaccattcacatccaccatcggccattcaccatccaccatccaccatccacctattcaccatccaccattcactcattcaccacccatccttccatccacccaccatccaccacccaccatccaccaaccactattcatcttaccatccaccatccaccatctatcatccactatctaccatctgccgcccatccatccacttaatattcaccatctactcatcaccattcacttgtccattatccaccacccaccaaccatcatccacctaccatccatcatccaccatttatccattatctacttatctaccatccattacccatccatttatcatcctatccaccatctactatccacccattatccactatccactgtctattcactatccaccatctattcactatccaccgtccatctccatccacaattcaccatttatgcaaccatcatccaccatctatccatttaccatctatctattcaccatccaccatccatccattcagcattcatcactcaccaaacatccaccatttaacacccacttttttttttttgagatggggtttcactcttgttgcccaggctggagcacagtggcgtgatctccgatcaccacaacctccgccttccaggttcaaacgattctcctgccttagcctcccaagtagctgggattacaggcatgtgccaccatgcctatctaattttgtatttttagtagagatggggtttctccatgttggtcaggctggtctcgaactcccgacctcaggtgatctgcccgccttggcctcccaaagtgctgcggttacaggcgtgagccaccgtgccccgccaacacccactctttatgatctacctgtcggccatgtatccatttatgccattatccatccaccactccctgattaccatccattccttttcctttttttttttttttttttgagacggagtctcgctctgtcgctcaggctggagtgcagcgcacgatcgtggctcactgcaagctccacctcctgggttcacgccgttctgcctcagccccccaagtagctgggactacaggcgccttctaccatgcccggttaatttttttgtatatttttagtatagacggggtttcaccgcgttagccaggatggtcttgatctcctgacctcgcgatccgcctgcctcaccctcccaaagtgctgggattacaggcatgagccaccacgcccggccattcattcatttttcactcaccatcctcatccatccattcatcacccatccaccctctatcactcaccatccaccccgtcaaccatttaccattcatctgccatgcgtccatatgccgtacaccatgcaccatcaatgttgctgtccatcagctgtcccctactcaccatccactactctccaccatcatccacaatccaccctcctataccatccacataccatgttccatccaggatcttccttctatcatccaaccaccacccacagcccatgggacaggggcactgcgtggagaagtggacacccagttccaatggtgagcagactagctcagccctagcagcacacaggacagagaaaggggtgaattcaaaggtcgtttattccccctcccggcaagacacccattttacagggtaggtcagtctcgccaagcccttcttctttgcccttcttcctgagaacctaaggtgttcaggccctgcaggggcgggtaaggggaggctgagaaggtgcctcccaggggcctgaagagtcggccctgggcgggtctggaggtaaatgtgtaaccgaccctggtgcccccacccgacctgcctggtcacgtgggtccagtggggcaaagtctcctggtggggtgcaaggagccgaggcgagatgggcgtcctgggccgggtcctgctgtggctgcagctctgcggtgagccgggaccacaccggtgcgggcccggacggtagcggtctgtcaggacccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagaggaggggctccgggaacctcggccagccccggcctccggcggctcctgccctcgcggtttttccgtctgcgaaatgggcgcggtccccagaacctgccgagagcagcgagtgtgcgcctgcggggctcggcagaccgcctcagcttcccggtccccaagggagcactgagccctcctccgccttcacaccaggccggcgcgtgtccctggcgcccccttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccagggtctgggtccgggcccccggggatggggttcctatgcgtcccgggtgatccgcgcggaccttccgcacttctctgggtgggtggccttccctgagaagggagcatcccggagagcatcccgggcactcagtcgcctcctccccagcactgacccaggcggtctccaaactctgggtccccaacacggacttcgacgtcgcagccaactggagccagaaccggaccccgtgcgccggcggcgccgttgagttcccggcggacaaggtgcctgggagcgccggcggggtcggtgatgggcctggacccctgagaccgtgtggccccggtgggggttgctcccggctcggctgaggcagcttcttcctgcagatggtgtcagtcctggtgcaagaaggtcacgccgtctcagacatggtaaggccgggctgctactgccactgggctgggggttcacagagtctctgaagcgccttcagggactgctgtgccttgagggcggaccccaccggcatggaggcactgcaggactgggactttggcctctggagaatattctaggaggcagggagtgggggggaacctaggggagcttggtcccatggtcccagccaggctgtgtcctgggagggatgggaggcacccctgtccccacagcccttgtgatgcccagcagtgggtggtcttcccaggaagcgcctgctccatgcccttcccccaaagccttgccttgtcctggtgcctaaagctccatctttagaacactagggaaagtgtccccaacacccccccctctacccaccatccgggtccctggcctgttaggaagtggccgcccaggaagaggcgagcccactcctgcctggctctgcctcccttcagatcagatcagattctcctagggacccctattgtcactgcgccagcgaggggcctgggtgggtgtgcactccttaagtggctgacatctgagatgggacagcttaatcctgaaaccttccccactcccatcagtccatggaagaactgtcttccacaaaactggtccctggtgccaaaaaggttggggactgctgccctaggggacctttttctcaaactgcttcacacaacactccaagaacatgatgggaactgggaggaaagcgggttccatgagtaggtaagtttgggaaatgctgcagcctgcactttcctggagcttcatcacgtattaaaggctctgataaggccccagagaaagaagctaatttccttgtttaaggtggagttccgcaagctacaggccaaatgcagcccctacgggtggagcaaggaacggtttttacactttgtaatcgttggggaaaaaaagaacaatcttttgtggcacttgaaaaatatatgacattcacacctcagcgacagtaaatacagcttcactggcacacagcctgcccgcttggttgagtatcctcggtggccactgtcccattgcatcggcagcccaccagcttccagggtgactgtggggcctgcaggccaagcctctgggcaaaagcttccttccagccccttcacagccactcctgggctgcgtcctcatcctgtcacctgcacacctgccagctcagtcactcctgagtgagggtcactggtgagctgggtcggggtgtcggctccagatgtggggtccaggcctggggcccccgcgtgtgcgggtggggaggatggctcaatgggcttggcctggcccattcctgccccatgcggggtcagggaccctgggcctcatttccaccccagggccgcttggttccttccttcaggttttccaaagctgccttaacccaaaagctgccacacactggggagggcacccacagcaagatggcgacgctcccacccgggaaacaggaggagggcagggagagggaggcggttgccccttgtggcccggcccccagaacccacgcataaccttggcaaccaggcagcccgagtgaggggggcactgggagctgatgggggacctgtgggcagaggagtcaggctgggctgggggttccagggcatggatttccccctactcccctcccctgccggcctccttactttcatgatctcctttggaagcacttgggctctgaaaggaggcaatactccattcattcatctattcaataattcattcattgatcatccattggccggtgggaacagcgcaggggcaggggacagtggccccagggtcccagcctgcagaggccgaattcacccagagccgcccaagcacccccatcccctgcccgcgtcggctatgttgccctccacacccctggctcccagcttcatccatctgcctagatgaggcccgagtaacaggccgtgcacatcagtgccttactttgtaattctgtggttgggagcgtccctccctgcgattttccttttccttgcccttcctcccatttctaccttttgcctgctttcttgttgggggagtctcctgtctttcacccatccccctgccttggctggaggctttgcaagtctgctcactgtggacttgcctgcagtgtcctgtgctgaacagaaaccttcattttaatcgacctaatgcaaaacgccttaccttagaactgtgttttttctgtttcgtttgagaatcgcgtctgctcctcagtcacaatggtaatggactgtgtacctatggggcacgtgcaccagcgagggctcctgctgtgtttctctccttagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctctaaatatttcaggtcatccatggcctctttagcatcttaaagttttccctgtagaggtcttatattgtattggttaattcatcaatactttgttaagtttgtttttttgagacagggtctcactctgttgcccaggctggagtgcaatggcgtgatcacggctcactgcagccttgacctccctgggcgcaaacaatcctcccacctcagcctcccgagtagctgggactacaggcttgtgccaccacgcccggctaatttttgtagtttttgtagagatgggggtctcactatgttggccaggctggtcttgaactcctgggctcgagtgatatgcccgcttcggccttccaaagtgttgggattacaggcatgagccaccgctcctggccttaagtttggtttctattataaatgttgccctatatttaaaaattatatcctctttttatttttaaattttttgtagagatggagtctcactatgtttctcaccaggctgatctcaaactcctggccttacctactgtgctcgtctgttcaactattatgttacgtttctatttttccccttcgttctttaaaaaacggtgttcttggtatgcttcctcctgggaacccctccctgttcctgaggcgctttgagctatgacacattccgtccccacggctccacctctgcacctgtggggggacttgccctgctggcagtgccacaccctcaggtgtgcacggaactgaagtgtgacctcacgtcgctgggggtgttggcctcttgctcaggtgcagtgctcctggaagggccgaagagtgggtcctgcctcgggtgggcgcgccctgctgtgctgagcccctcacaacctggcagcaagggttgccctggcccagcgctcaccctcagcccctgagggagaagtgcagaagcaagaaggcaggaggctgaggtcctggcacttggaggagagggggagtgaggggcggccagtcagaccccccgtatttctgctgacacccgagacttgggctgtggccccacttctgtggtgcgggagctgcacggcccagcccaagcctataggaaacagcaggggcaactccacctccccgctacactccctgcctcctcctgcacccctggccgccagatgcagcctctccctccctccctcacacaccaagagcgcggcctcagactccccaggagccgggcaactttcgaaactttagttcctggaacctgggagccctgggcctgtgcacgttctcaaggggctacggggggaggcgacaggccctggccagagtcacctccgccccagactccccacggctccgtctcgctccccggctccggctctgcccctggcctgtgagacctccagctcagggacaggacactgggctgtgcccgcttcggggccttgcccacgcggccccatctttcccaggccagatccgcttcctctgccagcctcagccaggccgaggaccccgggcctgagctcgcccgggctccttccgtgcacagggtctcggcttctcgtcccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcgagggtcgggactgtgcccgggacagggccgctgcgctcccacggtctctcgccggcttgcttctcggaggcatcgcccttctcgctgcggtccgctctggccctccgcgctgaccaccgcccctcgcaccaggcgcagccgtggatctgcgcggccctgctccagcccctgggcggccgctgcccccaggccgcctgccacagcgccctccggccccaggggcagtgctgtgacctctgtggtaagcgcccccgccgggccctgcttgctgggaaggcctggaggaccaggttcgtcccccgcctcagtttcctgccgggcccggatccacggcgctgacccctgccctcccgccgcaggagccgttgtgttgctgacccacggccccgcatttgacctggagcggtaccgggcgcggatactggacaccttcctgggtctggtaatggggccgcgcgggcagctgaggggagtcccgaccccagccctaccgcctccgcctaggacgccccttctgcagggtccctgcggctgctcacttgcccactatctgcctctgcccttagcgtccccataggctcggggagggcggggggctgagtcaaaccaaccccgtccccctccccagcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggtaaccgcgcccgccccatcccgccccgccgcgcctcgccccgccgcggggaagactgagccggcccctccgtcgcaggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtacgcggggcgggggcgcggaggtggggctgggggttgctccgaggggctcacgctgcgtccccgctacgccctcaggtggaggaggcacgaggcggcggccccggctggagcgcccctcggcttccgcaacccggtgttcgacgtgacggcctccgaggagctggtgagggggctggaggggggaccggggcctcctcggggccgggactcggcgccgaccgccgcctgaccctgtcaccccgcagcccctgccgcggcggctcagcctggttccgaaggcggccgcagacagcaccagccacagttacttcgtcaaccctctgttcgccggggccgaggccgaggcctgagcggccgcctgaccgtcgaccttggggctctccacccgctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatggggtcacccatgtgcaagcgtgcgccactgcaccgacacagacaagggtccagccctgtgtgtgcagctgcaactgtggcagtgaccacttctgtgaaaccagcatctggggctggagatgtcaccggcatccccagtcatggcctggcccccatttggaatcttctgcccaggggcccagcttagccaccaggacacgtgctgtaacccagatcagggccccgtgcttcgaggtgcggctgtgttgtggttggaatgagtcactctcagtgctgtgcagtgtcccgttgagtgaccgccacagttcacgtgtgtgctccaacagctaccatctcgcatttttaaaagaagtggccgatactcccacacgcactttttagccacaattttctttagtgtcaggtgcaaactggagagcaagcctgagctgaccagacaccacctgccacccactgctcacccgtcacagatggactgtgctggcagggacctgcctctggtgtggactgtggaaggagagatgctctgggcttccaggggagccgcctgctgcagcagcagcccaggccatgctgcctggcacagagctcaaggtcccaagtgcccccgctgggtgctgggctgcctgccctggcttgcagtcttctcccaggtccgcactcttctgcaggggccatcactgcccttgtcctaccaaggacaactaggtctcagtgagtggcaaatagaagccaactccctgcataactcaggaaactgactccgagcattccctcaaccagggaccactcaccctggcccagacctccccgagaactcctgcctcttcctggggcctctggcctaccccatcctgtcccttggggctgctggcagggttggcgtgtatgggtgtggacaggcagaccctcgcgggcagcctgctcctggggccctggcactgcctggctggggctcacaggcacgctgccctcctcccttcactcctgccccaaggatgccctctgttcaggctgaacaccccaacagcagccttttgggtgacctccgagtgagttacccagaatagcttctgctggcgaatagcatcttctgcaaggtggctccttcactgccttttggagctcaggcacttctggggcccagacacacgggtgacatgttaccacatccaaacggaccactgggaactttaaaactgccgtcttctgctttattgacaggtaaattgttcaaaaatgttctcacaattcaataattaattacaaagactgagacttacattaaaaaagtaaaaaccagaaccccccaggtgcccatccagcagaaggcccaggagggcagtggggtggcagggctaggcggtgctgggccactcagtgccgacttggggaagtgcacgtcctgaacagccttgccaagcagccgaccggtgggaggacaggggaagcctggcccaagctgtggacaagctgtgtctgccgccacagttaatcacaagcctctgacgacacagggccacagagctggtcactcaacatctggtacaaagggtgaggtgaaatccacgcgcaggggattgctgtgccgtgggccggggccagtgtgcaggagtgtgttgggtgggtctacgtgatcatacgggctactaatcacgggggctccatgcgggggcaggactggtgggggggggggcgggcagggcggggcggggtggggtatcccagtggctgcttcgtggcgccctggggctctgacttccctcagcccagcaggccacagggcctgcctgcaccacgacactcgctggttttatggcaggaggcagaagccgtggaagcgaatggaaaacagcacagctgacttcacagtagtagatactggtgacacttcatggctgcgacccagaatgaacttaatgcacacagggacgcagggtgtcactggtcctgggcctttgtccatgactaggtggtcagcaggacttctgcagctgactgtgcaatggctaaatgaaaaaaaggccacagactaacctccactttcctgtcttcaaaattctagtgacactgggaatgctataggacctcctactattctcttaaggtcctaggaaagtttcaggaactagggaaaagactgggtactgaggctgtgtccccagatgtctgcttccgaagcagccgcgtcatgacgggtttctgctgaggaagtggtgttggcagggccccatatgccctctcgggttgtcaggggtgggagacaggctgtatgggggtccttcatgtgcagatggaacagcatcgcctcacagctgtgcagacgaacagatgtggtctactgccacgaacaatgcggcataaaactgatcaatattataataaagatttgtcttcttcatctccatatctacaaagtgattctacatttccttggacaacactggagggcccgctcagtcttggcactgacgctggaggccatctccagctccctggcccctgtggcgagctggcggcttcaggtgtcacaggccggctgctccaggccttcgagggggagctggctcctgtggggggagttggggctcggtgggccgctggggttggagctattcgatggagttgagtgtttggtggagtccgaatcaggctgtgaacaggaagagggcagggtgagcacccgctgccctagcctggggaggcacgcgtgcccagctggatgcaaatgtttgctcagggacaactgtcgcaactgctcttctcccttcatgttatgaaaacacacacgctctacaccagcgattcgtggggcccttaggcgtgctggtgagagtcacaaattgatgtctaatcccactcaaaaataacatggtaattatcattacaaaagacagcaactctgtagtgaagaaatcagatggggccggacgcagtggctcctgcctgtaatcccagcactttgggaggccaaggtgggtggatcacacttgaggtcaggagtttgagaccagcctggccaatgtggtaacaccccatctctactgaaaacacaaaaatcaggccgggcgtggtggcttacgcctgtaatcccagcactttgggaggccaaggcaggcggatcacaaagtcaggagattgggaccatcctggctaacatggtgaaaccccgtctctactaaaaatacaaaaaattagccgggcgtggcagcatgcacctgtagtcccaactgctggggaggctgaggcaggagaatggcgtgaacccgggaggcggagcttgcagtgagccgagactgcaccactgcactccagcctgggcgacagagcgagactccgtcacaaaacaaaacaaaacaaaaaaaacaaaaatcagccgggcacagtggtgcgcacctgcaaccaagcagtcaaagtcacaaacgcgacactctttcctgagaaaagcactaggaatagaggggaacctcctcaacaaaataaaacagctaaccatacccaatggtgagagacaaaattttcccctaagatcagccacgggccgggtgcggtggctcacacctgtaatcccagcactttgggaggccaaggtgggcagatcatgaggtcaggagattgagaccatcctaacacagtgaaaccctgtctctgctaaaaatacaaaaaaaaattagcctggcatggtggtgggcacctgtagtcccagctactcgggaggctgaggcaggagaatggcgtgaacccaggaggcggagcttgcagtgagccgagatcgcatcactgcattccagcctgggctacatgtagagtgagactctgtctcaaaaaaaaaaaaaaaagaaaaaaagaaaaaagatcagcaacaaggcaaggatgcctgctttcaccactgctattcaacatggggctagaggttctaggcagagcgatcagggaagaaacagaaatgaaaaggattccaagttaggaaggaagtaaagctatctctctttgcagatgacatgattatacacgtagaaaatcccaaagaaaagaatccacaaaaaactaataagctcagcaaagttatagggtataagatcaacacacacaagtcagttgtgtttctatacaccagaaatgaacacactgaaaaggaaactgaaaaaaaaaattcaatttacaacagcatccaaaagaatagctaggaatagtttaaccagagaagggaaaaatgtgtacactataaattacaaaacattgctgaaaaaatagcttaaataaatggaacacatctcatgttcgtggagtaaaaatattgttaagatggctgtactaggccgggtatagtgcctcacgcctgtaatcccagcactttgggaggccaaggcgggcagatcacttgaggtcaggagtttgagaccagtctggccaacatggtgaaaccccgcctctactaaaaatacaaaaatcagccaggtatggtggcgggcacctgtagtcccagctacttgggagtctgaggcatgagaatcacttgatcccaggaaacaaaggttgcagtgagccaagatcgtgccactgcactctgtctcaaaaaaaaaaaaaaaaaaaagacattaattatgaggaatgtaaataacgacaacccatagaacaagagaagacatctgcacatcacatctctcacaagagcctggtactcagaacatgccaggagctcctacaacccagccacaaaaggacaaaccacccatttcaaaaatgggtaaaggccttgagtagacatttctctaaagaaggtacggaaatggccaacaagcatatgaaaagatgctaaacataagtctttagagaatgcaaatcaaaaccacaatcaggtactacttcatagccaccaggacgactattaaaaagaagaaaaacaagaacaagtattggtgaggatgtcgagatatgagaaccctcacattgctggtggaatatagaatggtacaactgctgcagaaaacaatttggtggttcctcaaaaagttaaacatagaattaccacataaatccagcaatcccactcacaggcataaacccgaatgtgaaaacaggcactcaaacacatatgtgcacacacgtgttcacagcagcaccactcacaacagctgaaggacagaaacagcccaaatgtgcctcaggggaagaatgggaaaacaaaccgtggtctagccatacaagagaatattatttagcaatagaaacgccagcactgatgcatgctacacaacgggggtgagccacaaaacagtatgccaggtgagagctaggcacaaaaggtcaaacacactgccatacgagaggctgggcattccatttccacgaaatgtccagacagggaaatcacaggaaactactggctgcccaggtgctgaggggagggagggacggggagagagtgcttaaagggcagggggtttattttgaaatgatgaaaatgtcttttttattatgttttagagacaagatctcactacactgcccaggctggccttgaactcctcaggccatccttccacctcagcttcactagtagctggtactacacacgtgaaccgtggtgcccagctagagtggaaatgtttctgaatgagaaagaggtggtgactgcatctctgtggatgtaccaaatgtcactgagtagtttaaagtaactttaaagtagttattttgggcccggtgtgctggctcacgcctgtaatctgagcactttgggaggccaaggtaggaggacagcttgagcccaggagttgggagaccagcctgggcaacaaagtgagaccctgcctctatattattatgaaaataaaaaaaacaaaaaaattgttgttttgtgaatttcacttaaatttaaaagaacaaacaaggtcatgcagacgagacaggcactggctgcctcaggacacagtaccctaagagggacaccatgtcctctgtataatgtgacagcctaagacacacttcaaatcccatgaccaggaaacagcggacaaactcaaactcaggagcgttctgtaaagtaacagcagtgcttgctacaaaaatgtgactgtcccaccagacaaagacaggctgggggcctgctgcagaataaagggtggaacagtaggatggacaaaggatggagaagacaaaggacttccagaggaagagacgctgaccttggcagaaccagcaacatgtgcaaggcatctgcccgtccgttcggcagctgatgttaaaacatctcagtgctggggctgagatgtgtggtggagagatgagcatggcccctccgcctgcatccctccctccctccctccaaggatggcgccgggggctaagccctcagctcactcctcagccctcagcactgcagctcctcgcctccctcgactgcattctcatccccattccgcacaggggaaactgaggccagagcagtgtggctgagctgcgcacaacagtggcgcttgtcctggaggtggtccccacactctgacaccaagcgccatcccaagggaggggcagacagaccaaccaatgtggaaggtcagcccagaccaaagagactgctgatgtatcacattgaagtacataaaacaacacagggagtccagaggaaagaggcaggttggcgggaaagcttccattcctcctggggcagtgtgacagccctgtccctagtcagcgttcccaaaggagcttggggtctgaccaagagattgctgcacgagcctcctgggggaggggacagccaccccgacccctgcccccgtcaccctcacaccgcaagtggggtgctccaaaagggctgtgacaccacccagggccccagatcttcgggctgcttttcctcctgcagtggtggctcatagcctcagcactggacctgggcaagtctcacctctttgtcaaagtcctggtctggatcagacatacttctcagaggcacagtcacgctaggctccgatccacctacagaacaaggacagctttcctcttagggagaaagtcaagaacggaatcaaatgcctggggtctccccattccagcaccccctaccccccacctcccccagggctgcgggggccaggcttcccctgtacctgatgagggccacgagatgtagggcttgttcctggatggaggctggcgagccaggttggtgggagcggggcccggcctttcctcctgggaggggggcacagcactctgggcagaaatagcaacacgtgagcatgcttggttgacacccggcagggccggctgcgaagtttgtgcaacctacggtggctgtggcctcgtgaccttgatgagcaaaatgggggccaagagggctctctggattggacaagggttctggacagtctggaactaagaactggcaatagcaacttcagggcaggtcaaatcctataaaaagcgtactttttttgtttgtttgtttgagactgagtcttgctctgtcccccaggctggagtgcaatgacgtgatctcggctcactgcaacctctgcctcctgggttcaagcaattctcctgcctcagcctcctgagtaggtgggattacagatgcccaccatcacacccagcttatttttgtagtttagtagagacagggtttctccatgttggccaggctggtctcaaactcctgacctcaggtgatccactcactgtggcctcccaaagtgctggaattaagaggcatgagccaccacacccagcctaaaatacataattttttttttttttgagacggagtcttgctctgtcacccaggctggagtgcagtggtgcaatctcggctcactgcaagctccgcctcccgggttcatgccattctcctgcctcagcctccccagtagctgggactacaggcacctgccgccacacccagctaatttctttttgtatttttagtagagacagggtttcaccgtgttagccaggatggtctcgatctcctgacctcgtgatccgcccgcctcggcctcccaaagtgctgggattacaggcatgagccaccacgcccagccaaaaacatacttcttaagtaaaaaagagaaagtatgctatctgttggtacgaaggtgttactgagaaatcaccacctcatggcaaacgtccttaggaagccctcacaggccgaaacgtggtggactctcacaagtacctgcagcatcactgcccagggcggcccgaggcctgtgcacaaggccttgtgacagggtaagtgctcgtgaacagagcttcagcggagacgggcttgtgtgacaggagcgccaggtcagagcacagcgccagcctcgcaggcactgcctttgggacagtctcagccagcatggctgcctgagcggggaggaggagatggggtgccctgcccgccctatcccggccgtgcacgcaccagaggcaggtccatgagcacctgcatgccgtcgcctgggcccatgtgggccacgtggttgaagttggttgggttggatatcattttggatctcaattctgggtctctaagcatctctctggggaaaggacacacttttgagattcatggatacgtgagaatcctcttggccccctccctagagcgaggcccagcaggccccgtgaggccccgctcctaccgcctctgctgcagtctctcttcctctgggaccttgaagacgaaccgccttttgctcctggtgcgcagcatctgcttcttgctgttgtcggaggtgtccggcacgttgagaaccgctcctgcagaagcagagcgcgcggtgacggtgctgcggcaccagggacacacgcccctccaacttcccttccctccactcccggtgcagaggaaggctcacccgagaacttgctcttgaagtagatcaagcgtggaggctcgcagttgaggaggttgagggtgccttcagagttcaggggccttatctggattggaaaccagggagggacagtaagcgcggccacgcacagactgcaccgggagaagcccgcccgcacaggagggcaccgaggccgccttaccctccgcaggccgatggtctgcacccactccatggtgcgcacatcaaagacgtccacgccatactcgctgtacaccgtgacgtgggtggggctgcaacctagcgcagacggagcagggcggggtgagccacagtggctcaggaactcacctgccctcgggccggaggccaagccttggcacttgaacaagtgcagaggcggcagcactgccctcagctggttcacgtcaccaaagacttcatgttcccactctggaattcatcttcatttcaaagtttaaacaaacacaatccaatgtttaaatgctccacaatcacttccgtaactaatattttgaatactacagtacagatgttgaaggtgacttttaaaaagtctggtttttcatttagctctcatgagatgtgattatcctgaaagctactaattcaggctcaacactttggaaattcaggtaggggccgactgttcagtatggtgaggctaattcttccgtaggagatggcaagtccggtttccaggtaggtattaaaaaccacacagaaaccactgctgacctctgggcaacaaccctgcctgtctgccctccacactaatgaccctagacccctaggaacccgtgctatgggggcgtgggaagcccctctgcagcccggtctgagggcatatgcaagcgaggctaagggcgtcctgcagggagctctggggtccgcgctgtgctcctcacctgctcatctgttggcttacagaagcaactccacccaaggtgccacggatgtgaaaccaaggactgcaaagcctttggccatttggagtttaaggggctttctccacgtttagaagagcagtgacacagctgtgccacacgacaagggagcggtgtgcgtcttccgctcagtccctctgtgtgggtggcacgctcactgcccccacagcccctcagcgtagcttggctcctggccatcagcttgcagaaacgcagagctgggaggcggcaagccccaaatgcaagagagctccagctcagtgctccttcctggctcttctgcctccggagttcaaggttaatcctgcatcaggacacacctcactgtctgaagatgcattttaaaagccttctgctctgtttctatcacagactccaaacaggctacaagatcaggacttttcttctgaatacaaaaagggaaatcaaacagggtttgcaagaaagacaaaagatactggcctggtcaccaaactgtctcagaaggagcatttcagatgcacctgtgaggcctctgagaaccaagtcaaaagcagccccagacactgcccttcagggaaccactctccacacgggcttctgggaaggcccttgcctgccgagtatgtggggattcgcttgcaaggaagcaggaagaagtctagtttgctgactcagtgataaacagatgcccagtgaaaagattctagtgaaacagattctagtgaaaagaacatgggctctggagcctgacagatgtgacatgtgactgatacagagcacgcggcccctgtggccttcagctgcctcctctccaacagggctgataacacctgccctaagggatggggaggggcaggggaggccacccacacagggcactagcaaagggtgcagaatgagcagttctgcatcctacaggtgatggaattacttttgaccagctctgaaactcatctgcatctgcactgtgcccgcaggagagaagacccaccaaggcggagaaccgaggaacttcaggtgtctacgccagacacgtgtggccaagattataaatacattgcactaagtgacctgggccctcttcaacgttacgctttgcaaaaatgtaaatcctgtgtggttttaaaccctgtgctggctgcctatgaagaggacagggtgttggggggtaagagtccaggacaaggggtgctgaggcagcgggactggccccttcctgcacctcaccgcaggcccacggcccagccccactgcccacacatgtctgctgtggtgtggccatcgggatggagccgggacacactgcagtaagcccgtgggtggagctggccgtgcacctcacaggcctggtgtctagccacgacgccctgggtatgatgccgtctcagcaaggctgacaatggggcagacaaaggggtttagcttcaggtaactgagggagaatgtcattccccaactcttggcctgttacccccatatgcgcggctcgtcttcctcccggcctcctcttgatctgtggatttgatggtgcaggccactctgatagatcagagggattctgaggtttaaggtttcctttctgttttaaaagacagggtctcactctgtctcccaggctagagtgtagtggtgtgatcatggctcactgcagcctccatcttctgggctcaagcaatcctcctgtctcagcctcccaagtagctgggactacaggcatgtggcaccgtgcctggctagtttgtttgtttgagacggagtcctgctctgttgcccaggctagagtgcagtggcgcgatcttggatcactacaacctctgcgtcccgggttcaagcaatcctcctgtctcagcctcctgagtagctgggactacaggcatgtggcaccgtgcctggctagtttgtttgtttgtttaagacggagtctcgctctgttgtccaggctagagtgcagtggtgcgatctcagctcactgcaacctctgtgtcctgggttcaagcgattctcctgcctcagcctcctgagtagctgggactacaggcgcccgccaccacgcccggctaatttttttttgtatttttagtagagatggggtttcaccctattagccaggatggtctcgatctcctaacctcgtgatccgccctgccttgggctcccaaagtgctgggattacaggtgtgagccatattttgttatttagtagagatgaggctggtattgaacttctgagctcaagtgagcctcctgcctcagtctcgcacagtgctgggattacaggtgtgagccaccgctctccacccggtttaaggttttaaaagcaatcggacagcgggccagtcgggaagtgtccactggtcctacctgttccccagtgccaccattcatagagaaagtcatgccaactaggcgaattcagtgacccaactgtttgaaaaacagcccctaccactttcagaaaatacttgtccttagagggactgtaacttaagacaccagaggtgaattattttctggccaccaaaacccctcaagcttgtctttactactgtgtaagtttctgtattatcacgaggaaggccttttaaatgagagatgaatgccacgccccgttctcggttcgccgagcccttctgcccaggggcctatgcccgccgacggggtcctctgctgaggcctctggaagaaccggccccatgtgctcagggagagaggttgctgagcccgcctactgctggtctgagacgtgagatctgaaccatgctctctgctgcgggctggcatggggcccacctctcccgatgctctgtgactactcaactaagggactggaagacaaaccaaagcaaaatcgaacacatgctgactgtcggtgggaaaagcagcaacagggatatgcaacagaaaacatatacatactacaggcgacaggagccgcaggccacatgagctcctgcgcgcgtgccctccggccttgcgggtccacgtacagtcccatgtggctgaagcaaagcaggtactcctcgctttcgagctccacagcacaaagggcatcaaaagactgttgtgagaggaacgcaagcgaggggtcattgggatttaccaggtttagaggctgcccgtccccctggatgctcagcaggcagaacccagaagggtagcccacacagagcctgtccctgagcaccgccaggcactgcacgctgccgggagccacaatctcattgaactttctgtggaatggcttcgttctctggatctcatagcaaaggatcagccgtttcacggccacaaacaggcaggtgccagagttcctcttgagtgtggccgtggccatgagctggcagcctttggtttccggaagcttgatgtcaaagctgccttccgctccatcaagggacgaccacggatagaggtgcacatggtggttccggccacagaggaggattacgatcttctccctgggagcaagctcgatctggtgtaccttcttacagtcagcggcacggacgatcactgtggcaaggaggacaagagcgtgaggccgacgggacagccagcagctcccaggggctgacggccttggctaaagacttgcctggaacactctggggccctcccctgggctcccttcctgtgtgcacagcctgagcccggccctgagcccgtctctgcccacagagccagtggcttgaacgccccccggagaagctgccccacatccacagcgcgctcctggggcagcctcgggggctggtccaaaggctcctctgcctctgctgctgtgcacacccctcagtgcaccagggctccagctgggcagcgcttccacctgggtcctcgcgcagcaaggccctggggtgatctgggcctccttccagctcatccccgaaccagagggccctcacgctgcacatgagggacaaagagctgtccccaacccactgggaccctgagacaaatcctctgaagacgctgccctcacagggcccccagtgaagacactgccctcacactcacacggcccccagtgaagacgccgccctcacacggcccccaggctaacccaagcccctcgcttgctcagatctccccacagagctgccagggtacggcctcgcccagcggctgccccgcccttctcgctccacggccatcacatgcagagatgctgggtctgtcgggaaaggactatggctcacatgaaatgtcgctggattccttgagggatgctcccctgggcccctgccccctgcccatggccagttccagtctcctgacgtttctgctcctagacccagggctgtggagcgggtgcatgccaggatacctttgcccttcctcgctgggaagactgaagtgtcaaaattggaagcaaagaaactaaagcttctcaagtgaagcctcagcacatgtgggaaagctgcagctgttcctcctcccagggggctttccttgaccccccacccactcccgctcagtgctccccttgaagaactcgatggatgtgatacgcaacttagcaccgcgtcgccatgcactcgatgccggtcttcacggcacgctggcccctccggcgccttcatcaagcgcatttgtcttaacccttaggagctactgaccctgtgctgtctgcagaggccaggctgggcctgtgacatcccaggctggaaacgccctgctcactcaccatctcgggtgacctctatgacatagagcccttcttctaggccgactgcaatcctgtctgcatctgtggaggggtaagtaacatacacaaagtcagtacagccgaccgtgaacaatatgggtttgaatgcgtgggtgggctcattcacagatacttttcaaccatatgtggatgagaatacagcattccagggatgtgacacttcagtatcgggggtgactttctctctacacgaactccacagggccggctgactgtgggattgagtctgcaaggatttgggtgtgtgtggggctcctggagctgaccctcaggcttagccggggccaactgtactgtccgcacaggtcatctgctttttttttgagacggagtctcggtctgtcgcccaggctggagtgcagtggtgtgatctcggctcactgtaagctctgcctcctgggttcatgctgttctcccgcctcagtctcccaagtagctgggactacaggtgcccgccaccacgcccagctatattttatttttatttttatttttttttttagcagagacagggtttcaccgtgttagccaggatggtctcaacctcctgaccttgtgatccgcccgccttggcctcccagagtgctgggattacaggcgtgagccaccgcacccggcctcgtctgcttcttaacatgcatggagaaactgtctacaaacccaaatggacctgtgaccttcatctgattttcagatgggcactgcagcgccgccggaagtgctgttgcttcagacacctgaaggacacaacctttgggacgtacccacgatggcagctgtcaggatggccttgatgagaggcagcgagctgtcgtaggcttccaagggaacatgcacgacctgattcctcagccggtttttatgaaggatggactggagtccttctagaatcccaacccacttcctcttttcattctcattttctgtcagaatgagcagcgagctggtcttagaaggtgcacctaagagagaggccgtcaccttcatgacaggaaacagaagagaagagagaagtcatcaaacgccaaagccgcacgcagctaccacggccctgctggagccacgcaccccaggagcaacgggggctgatgtgcttcccaggcagggacccctgactccacctcgctgggcgccttgcagaggctcccgcggcaggacacggaaggggcggggttctaaacagccccgtgagatcgcttcctggtcccattttcgttaattctgcttttgtcaaaactacgagtagctgcctactttaaatctgctttcttgaataatcattataaaagtagattctgaaaatgtgtccaggaaaagcagatctcaaaaacactggcccaaatcatgcctccctgtgagcagcctctgagcacgcatgctaccaaatgaccatcgttccagtaacaatgatggtaatttcctgtactgtgtatgacagggttgtttctgaatagagctgtgatttagtaaaagctaatttatagacttagttttgttatcaaaattttgctgtttataagaaaattcccagtggagggggctggagggtttctttccccaattcagtcttctaggaacgtcctaatgctacaatgtctaacactaactcagtgagggagcactcactcagtcaacaaaaacgctggctccaattggctggggggcactggagaggcaccttcatgcctaacctgccacagcgcccgcctggcagtgcacacgctgtgaggacagtggccgggacgtggactgagtggaagaggagtttcagatgtaggagaagggagggtcagtgaagaggggtgtctgggaagaagccagccaggaggctccccgagacgggcacaggctgctacttggccaggacgggacgcacaaggacctggagccaggctggaggttgagaccctagggccacactggaggtgcgctgatggctgccgcagcacaatgacatgcctagaacaatcagttttaaccatgtgctttgttaaaaagattaatgaaaaattcataccctgaatatacatggaatatctcggcgtgtagcatgaatgacatctgaggccaggactgagctcacggaaaactcgtcatctctggtaaggaagaaacattgaccccgctgggagacacgcgcacaggacccaaggccctcccacgccctgccctgccctgccctgccatgtccttccaccaccgtgttctgcagtggagggcgggtccctcgcctccccagatgtaagaaacacgggcagggccaacaaactcaagactctggcaggtgtttcagggcttagggatgccgcaagggaaaccccggagcctcatccccactgtgctggtgcctccagactatgccagttacagaagactcggtttgcacttggcacagccaggcagtccctccaacagccaagtgcagaggacaagtggggtgaggggtgtggaagtgaggggggagtgggagggagtggggggtggtggggggtgggcgtggaggtgacaggggagtggggggtgggtgtggaggtggaggggagtcgggggtggggtgggggtggaggtgagggggaagtaggggggtgggtgtggaggtgagacggggagtaggggggtggggtgggtttggaggtgaggggggtggggggtaggtgtggaggtgaggggggagggtggggtgggtggagaggtgacggggagggtggggtgggtgtggaggtgaggggagggtggggggtgggtttggagggaggtgagggggagtggggggtgggcttggaagtgagggggagtggtgggtgtggaggtgagagggagtggggtgggtgtagagatgagggggagtgggggctaggtgtggagatgagggggtggggtgggtgcggaggtggggtgggtgcagaggtgggggggtggctgtggagagggggagtggggggtgggtttggaggtgggggggtgagggagtgggggtgggtgtggaggtgaggggggagcagggggtgggtgtggaggtgagagggggagcggggtgtgggatcagtgtggaaatgctgttctgaagaggttccctaaagagtgctgagccctccgatggggcccctgacttgggctcatgccaacttttcgtctaccagtggcccttcaccaccaggccaggggcacacctgtgcacagccagggactggcgggtgccccgggggaagggacatggaaagtggagtatgctgccaggtgatgccgactcaccctcgctgtcctcagggtacccacccagcagccctgcccccaagaaccaatgctacagatggagtacccagccccggcctgagcccagagcagtcccgtgtgcaccacacaacagacggtgcacgggcacagcacagagatgacacaaaggcagtagcatggctccgtgtgcaggccccgggctgagctaggcctcttagtgatgcgtttaccttcacaacaacattccacatgccagtaacatgaccactgtcctcttctcactaacagatgagccacagatgtcaactctaagaggaagtgggaaggaggccccgcctgctcctgcagctgacactgggtggcactgagacagggtcacatagcaaacgctacggccacgcacacccacatggcccacggctccagacttcttccacacaccagcacctgctgcggtctctaaaacgcacagacggctgtgggccgcgtggcttttctctgggatatcttctgcttgttcttgggcatgtggttttcttatgttaaattaattcccctgtggcaaacttctcaacgcaaacacatgcgaggcaggaagcgtctacagcgctcccgttcctgcgcacgcaggcccgtatgcatgtctgttcatacgcatgtgagcgcctgaagtcatgactaagctgtacccatttttgcaaccatacaataatgaagcaggtgaagtactaatgaggtgaaagactactaaggaacacaccgtccttttggctaaagatagctgaggaagattcacagagcaaggacagtgctgcccaaacgcagacctgagatccaagacttggctcgcaatgacaccaggctgggtggattttccttcaggcagatcatacaggaagagcttgcagtcacagacgactgcatatgcgcgctgccatcccttcttcacccccgtgggctttgggacctatgaataaaaacaaacagtggccacgttccaccaggccaggcaggccgccaggccccattacactcgttcacaatctccttccagctgccaggctggcggcagagctgtttggacagagggatgtttgcccaagaaggctcaaggcgttgctggggaggggtccatgcgtggcagcagacggtgccagggaaagctggcagctcagccaacgctgtgtccaccccatgcagggtgctgtggtacacgcagcccgacagtctcgtagaggtgggcctggcacagtggctttcagactgagcttctgcccactggctggacactcagcccaggatggactctgagtgagcgtctgcgtggaggcctcaggatgcccaggccattcagaacagcggctgcgccgacctgatggcctcagtgcccaggagggtaagccccctaggactggcaccagggccacctgccgcagcaaggggctgctttcaagagtggctgggcatggctattggtcactgcacctcacaggcaccgagggctgagggcggagatgaagccgcctaccttgacatggcctttgtaggctgttccgatgcctcgctgcacgtccacgcccagaggcctcttggactgctcgggaggtattgggcacacctggggggcaccgtctttgcaggacacgtggcaagcaaaggaacacactggaagagagcaagaacactgccttcaaagcttgctgcctacagagaagtcactgcagaacctatgccctgaggaggcaatttaataatcaccaggtctcgcctggaatcccagcactttcggaggccgaggtgggcagaccacttgaggtcagcagtttgagaccagcctggccaacatggtgaaatcccgcctttattaaaaatacaaaaattagccaggggtggtgaagcgcacctgtaatcccagctactcgggaggctgaggcagaagaatcgcttgagcccgggaggcggaggttgcagtgagctgagaccacactattgcactccagcctgggccacagagcgagactccatctcaaaaaaacaaaataaaacaaaacaaacaaaaaataatgatcaagtctcacatcaagtccagacacccaaaaaggtaagaacagttgcaaggcagaatccacacaaaagctcagggtttctggcatgaatgcgtcttcagcatgcgcacagggaaagggcccatggcagaagcctgcttccatgctgtccctgccagcccgggccgcctcccacacgtgggagtttctacacggcaattcaggccagcggtcatggggacgtggggtcttggcagccaatcaaaatgtgcatgagttgaaataacaaaaaacaatgcttctgctataatgtagaatgaagggcatctctgttcacagacccatggtcaggaaggcgtgagtgctcagagccagtgcgagtctgggctccaggaccctcccacagcactgggtggcttggggtggttgctcatctgtgaaatggggcaatcactgagggggtaagagcatgtcgaatcccagcacagggcaagagcacaagatatagccttaaaaatatgatgggctgggcgcagtggctcacacctgtaatcccagcactttgggaggccgaggcaggtggatcacttgaggtcaggagttcgagaccagcctgggcaacatggcgaaaccccatctctactaagaacacaaaaattagccaggcatggtggcgtgggcctgtccccagctacttgggcggatgaggcaggagaatcacttgaatctgggaggcagcggttgcagtaagctgaaattgagccactgcactctagcctgggcaacagagtcaaactcttgtctcgaaaaagaaatagaaaaaaagaaaaaaaatacgaatgacgaccagaagcagagacaaataattgtggttatctttagataatttgacagtggaaggttttacacaattacttttcctctctgattttctagaacagctgcagatgatctacttcgtagtaattctcagtagatgagttgagtcaccacagaggcgcacagcacaatggagcccccagcacagcagggatccacggttccacagacctttactgaggatttgtaaaaataaacctgccaggctgggtgcagtggctcatgcctgtaattccagcacttcgggaggctaaggcgggagatcacttgagtcccagagtttgagaccggtctgggaaacaaagtgagatccctcaactctctacaaaaaaaatttaaaaatagccaggcatgctggtggtgtgtgtgtctgaggtctcaactacttgagaggctgagacaagggaatcgcttgagctgaactgtgattgcaccactgcactgaagtctgagtgacagagtgagaccctatctccccactccccctaaaaaaaaccctgtcctcaaatcatgccaatgacatttcactttagtttggtttgcttgcatcagggctgccctggagccggctggtgcccttagctgcaggggtgtggggctgtgcacgctgaccccaggagctgcaacgacactcaccctcgcaggcgtagccctgccggatcagcccaaccatcagggaggtgcagtggctgcactgagtagggctggagaaggacttgatgctgaactggtgagcttttggctggaaggagaaaatcaagaacactgaggtgaaccatggactcttgagagtcagatccatctgcctgtgatccagtttatacacagcttgggcattatcctgaaaaggtggaaatgtgcaagttctggtcttggtctacgtgttccctaacagggctcatcaaatagtggtgaaaaccacctacgagcctgagccagagagaggccaacaaatacttccttcagtgggagagcactgctaccaaaaagcgaggtcagctgggccagagggccgaggtggcatggccagtgctctttctggctcatgctcctggcctcctggagaccagcaccaactggctcttgggggccgacctggggccacatttaggttgggctgcacacaggccttgcatgtgtccaagagacacccaagaatcaccgacaggaggacagttcataacagcaaacgcctggaaaggctcacggtccctcatcaggagtggacacattgtgaacccagcggcaactgcagcagccccaaggctgaacagagggtcgtggtgcaggccatgcgggaccgcctgtttaccaagctcaggcgcagcagagaccaatacgatcctcagcaggaaacagatgtgggtgagaccacttgcaagaagtaggggagtgaccgacacaaactccagagagctgtgggggaagaggctggctgaggtgggcagggaggccgtggggcggtggccgggccatcaggactaggagtgacacaccagcactctgcagagttgctatcaaatatggtaaccaaataaacgacctcgcgacttggtccctgactctgcaagagtcttagtccaaaagccaaacccttaggtagcctcatagaagtttggcttcttacgtccagccggcatagctgcctgtggcaggaagcacaggcagaggccgtgtctacattaacaacaacaaaaaccaccttaggccacagggctacgtactcgcaatgcttggaactcaggggcccgtcaccctggagactttctgatctgcgttgatgtttatatgaaagaaaaggggatgttacagaagaagccgaggccaggacaggggagcaggggcccagtggggccgctgtgctggctctccaggatgcacttgtggaaaggatgaggctcagaaccgcacatgcactgcagggccgtttatgctgggagtcattctcacccaccagccacatggttctgtaaggttctctaagtgcaggcagacaaatgaaaatcaatgtggagaagtaagctgcctacctgtggagaggggaatatggcttggggaatgagagaaggagagtggggagactgaatgctgaacttttccaattaaaatatatttgtgtagcactggtatcattaagaaaacacagggtcctgacagcttcctgaattacacaccattctcaacaactttcctacagaacatgagggtcgctactgtgtgtatgcaaaaatgactaagtatgttttatttatacaaaacttattttctaaataactgagaataaataaacaactaaataactaagaaggcgccccgggtgaaagcaaggcccctaccttcggtccagccagagccagggcctgcgtggtgggcaacggcacagcggatggcctctgcgggggccgagccatgtcctgggagacaagcaggacaggtgagtgtcggcccagctcagcatggctgagacacctggccctacggggtgcacttctctcaagaatgtgttaacagtgaacagttctgcatttttaatttgctacaatgttgagacatctgcggaagcctccctcatctaggggagggactgacagttaattctcaaaatgaaaggtgggcttgagcacctgggcagaggccctcgctgcaaactgttatgcaggggccaggtgagcagcatctggtcacctggacacgagggcagaccccaggtgggagcatcaccagggcaacgctgtctcacctcctgctgctctgatgcagccacagacatcgacggggacgcttctggcttcggagcttgtgtttcttgctcactagctgagctggtctgtgagaaccaagaaagaaagagtggggtgaaaggacatattctacatgatccagactctacttacaagttctttactaataaaagcagattctgtctagcccagaagtcccagcggttcttactcctggatcctatcaccccttgggtctcctcacagacccctgctccactcccagctggccggcctgccctgaggacccctgcacttggcttcctcagctgagtggtgattgcgtgggcaggtggagtctgacaagtcacagtcaccccgctgaggtgagaatttgcctggagacacctctaatgcacagccctgagcatacccgccccctcctgcagcctccttgccccggtcactgaaagggcaagacctggaaatgctgatccttcctgacctttattcataagtaatgttatctaagcctagcagccttaagatcaattagccaggccaggcacggtggctcacgcctgtaatcccagcaatttgggaggctgaggggggcagaccacctgaagtcaggattttgagaccagcctggccaacatggcgaaaccccgtctctactaaaaatacaaaaattagccgggtgtgctagcacacacccataatcccagctactctggaggctgaggcacgacaatcgcttgaacccaggagaaggttgcagtgagccgagatcaagtcattgcactccagcctgggcaacaaatcaagactgtctcaaaagaaaaagagaaagaagaaaagatcaaatagccaaatgcttcttaacctcatttcaaggatcaagaagaaattcgaacatcaacagaggtcggtgggcccatgagtagatttaagaatttccttgaaaattttatgacacagggaagcaatgttttgttttaacaaattaagagttctaatttcacagtgatttatttgaagctaaagctacactctgaaaccacttaaaaacaactctatttcaacaagtattcctgaaactaatagtttatcatcacaggccactgctgtttacagacgcacatgtaggtatgctgagtagcaagtgttagcaccagcaagcagtgtgatgggacacagacatggctgggtaggcgcctaaagcattgacagctgtattttgtgttccacatcagaatcccaatgaaccaaatcagataaacactttccaacagttgcaattaattaggccactgaggaaggagccaaattcagatgggatggcagcatacacacataaaacacacacacaactgtgtactgcaaattcacaagggaaaggctagctcgactggctaattaccaaagctcaaaaatgtaagcaaatctgccccataaacaaggtatgttaagtgttacggttccatctttagataaatgagaaaaagaatattaattttaggcatgtaaaagccccactcgtttcatttagttggttaattaatcaaagggatgcagattcaggaacaggaacattgaggaggctgtgcactaacaggagtgaaagctgcgggaagccagcgctggcagccacttacttcttcccaaaaggctagcagggaagatgcagacgaggaggagagagagtccttggaggtaacagacaggaggaacaaacatcatttcccacccagtcaacactggcatgaagatatattgacttaatcttggtgacaaactgtttctagtaaaaaccaacatgtttcatgcaggcagcgtgggataagaagtttctcaaagacaattttcaaaagagtctggaagctctaacagacccagcccctgatggagggttttttctgttcaacaataaatgccttcccatttaaatcacagagggattagcggccaggcacggtggctcatgcctataatcccagcactttgggaggccaaggcgggcagatcacctgaggttaggagtttgagaccggtctgggcaatatagcaagaatccatctctacaaaaatttaaaaattagctgggtgcggtggcgagcacctgtagtgccagctactcaggaggctgaggcaggagaatcgcttgagcccaggagtttgaggttgcagtgagctatgatggtggcacggcactccagcctgggcagcagaaggaagccctgactctaaaaaatggttaagatggtaagttttatgttatgtgtgcttatatcacaatttataaatcaattatgggccaggcatggtggctcacacctgtaatcccagcactttgggaggctgaggtgggtggatcacctgaggtcagaagttcaagaccatcctgggcgacatggtgaaaccccatctctactaaaaatacaaaaaaaaaaaaaaaaaaaaaaaaaaattagccgggcatagtggcgcgtgcctgtagtcccagctacttgggatgctgaggcacaagaattgcttgaacctgggaggtggaggttgtggtgagccgaaactgcaccactgcactccagcctgggtgacagagtaagactgtctcaaaaaaaaaaaaaaaaaaaaaaaaagggagggatgagggattagcaagggcaggcgtgctggctgtagagaatgaggcatgaagatgccgcctctgtctccatctctgctgcccactctccacagctgtgactcacacactcatggacagtactggctgtaaactcacttgctaccgggccctctactctgttaatgttacagaaagctaccgctttcctggccgcctccattcagtgatcaagcaccatctctggttctctggaatccacttattcctccccacagcagtgcccggctccgcagcaacgagagaggcaatgacttgtgcagaaacaggcttatcaaagatctggcgggcacttaccggttaaatagatttgcttcttcaaaactgtggatttcagggaaaagacaagcattgccagtttgataaaacaaacaaacattttgacaggtgaaggtgaacaggtgtgcgtccagagtggctgtgagcaatgcaagcctgcttgggtgttgtaatgacagacacaggccaggatgctaagagtccaccccaagggaggctgctacgggcagatgcccacatgggcacctgctgactgccccctactcacacaggcagcaaccctagccaaccccacctcaacccaacgatcagacttggcatcacccaccctgggcaggccggcctctgtgcgtggaaagggcacagctcctcctgaggagagtttgtgccaaaggttcaacccacaactgatgaagatgaaacatcagacaaacccagagtggacattctgcaggacaactggcctgggtaacaccaaaatatcattgtcataaaagggaacagatggggaactgttccagattaaaggaaacaaaagactaaatgcgattcatgacctccagatggatccagaactaggaggaaaagccagcaggaaagggcattcctgggacgacaagggacacatggatatgggctgtcccacggcatcagcacagaatgcctgatgacagtgacactgtggttatgtgagagaatgccccaatcgtaggaaataactgctgaagtatgttggggtcgctgataccttcaagtcgctttcaaatacttcagaggaagaaagtctcttatgttgagagagagaaagcagatgtagcaaaaccccaggtgagggacatgtacacatgcaccctattcttcccactcgcctgcagggctggagttttctaaatcaaaggctggaaccaccttccccaccctgcaccccatcaggagttccattagtgagctccactctccctgctccaatatgctttgcgtgctgctatcaagggtgcatccctacaggtttcaaagaggaggaaaggctgtcctgcctccacggaatgccaccaagaacctgcggcccatggagggaggcagtggggtctgctcctcactcgacagctaattcccaagtagatgaccagcggctccgactgcctgagggggttggcctccttgtgagggtctcggcaaggcacctggtgccagactgttcccatcaaccacctttcccatcgatccccaatgccgaactctacagctacacagatggaaacacaactaaagtatttttattcgctctagtgtgggatttttttttttaagagatagggtctcgctatattgcccaggctcgtcttgaactcctgggctcaagtgatcctcccacttcagcctcccaaagtgctgggattacaggcgtgagccactgcacccatcccagtgtgagaatttgtattattttcttgaaataatcgctacaggctgggcgtggtggctcacgcctgtaatcccagcactctgggaggccaaggtgggtggatcacctgaggtcaggagttcgagaccagcctcgccaatatggtgaaaccctgtctctactaaaaatacaaaaattagccgggcgtggtggtgggtgcctgtagtcccagctacttgggaggctgaggcaggagaatcacttgaacccgggaggcagaagttgcagtgagccaagatcatgccactgcactccagcctgggtgacagagcaagactccgtctcaaaaaaaaaaaaaaaaatactcactacacagctgaggccagtgcagatttctccctgaagaggctgagcactttcttaatctcatctctacttaatctgagttgagaaagcttctctgggagcacctcaaataccctaaatgtctgtcacctgatgcgtttaatgtgggttgattacatgtgggtcaattacacagttagcacaacgctgagataaacactgaatgtatatttactggtgtgtttgtggccccatgagtggtaaaatcatatatgacactatttctaacttatcataaactcatctgtcacttaaaaaaaaaacaatgacttactctaaatgtcaggtcatgtgcaagaggagcagtgttgaaatactcaaaaatggaatcctgaaaatctggaagtttgagccctgcaaaaagaaacaaagaatagtcaaggcaaaaaaactaaagtctacatattattttcagacagactcagtgtcttcaagatgtcaattctccttgagtaactgatacatctgacatgatcacaattaaaaaaaaaaaaaaaaaaaaaaggggtcaggcttttccccagagagtaacaagaatcaaaaagttcacttgaaaaagtaaccaagggactgggtgcggtggctcacgcctgtaatcccaacactttgggaggccgaggtgggcggatcacctgaggtcaggagttaaagaccagcctggccaacatggtgaaatcccatctctgctaaaaatacaaaaattagctgtgcatggtggtatgtgcctgaaatcccagctactcgggaggctgaggcaggagaatctcgagcccaggaggcagaggttgtggtaagccaagatcatgccactgtactccagcctgggcgacagagcaagactctatctcaaaaaaaaacaaaaacaaaaaacaaaacccctcaaaaccacaggggcagctgggctgggcgtaggtggaggaggagcagatctaccagatattaaagcagattcactaaggcctctacaataagaatcatggccaggcacagtggttcacacctgtcatcccagcactttgggaggccaaggtcggaggactgcttgaggccatgagtttgagaccagcctgggcaacacagagagaccccatctccataaaaattaaataaataaaattagctgtgcatggtggcatgtgcctgtggtcctagctacttgggagacagagacaggaggatcacttgagctggggagattgaggctgcacgtgccactgcattcctgcctgggtgacagagtgagaccctgtcacacacacaaaaaaacacatatcaaaaaacaagaatcaagtggttcttccccatgaacaatggaacaggggagaagatccagaaacagacccaagcccatggtgatcctgtacatgacaacagtcatacataaaaccagcaggaaaaatagcttaataactggtattggacaaccagctagccattagcaaaagataaaactggatacactcctcgaaccgtatgtcagagcaaatttcaaatggatcagtattctaatttaaaaaatgaggctgggcacggtggctcacgcctgtaatcctagcactttgggagacacggcagtcagattgcttgagtccaggagttcaagaccagcctgggaaatacggcacaaccccatctctaaaaataaataaataaataaataaatagccaggtgtggtggcacgtgcctgtagtcccagctactcagggggctgaggtgggaggatcacttgagcccagaaagttgaggctgcagtgaaccctgatcgtgctactgcactccagcctgggcaacagagcaagaccctgaatcaatcaatcaatcaatcaatcaatcaatcaatcaatcatgaagccacacaagtatgagaagcatgagggaatccctccaacaactgggagttaggtgtattttcctatttatgactcaaaaaaggaagaagactgaaaacttgacacacaaaaaattttgaaaaccacctttttttttttttcttgacagacggaatctggctctgtcacccaggctggagtgcagtggcgagatctcagctcactgcaacctctgcctcccaggttcaagcgattctcctgcctcagcctcctgagtagctgggactataggcatgccccaccacgcccagctaatttttgtatttttagtagagatggcaaaaccccccccacttttttttaagacagcgttttgctcttgttgcccaagctggagtgcaatggtgcaatctcggctcaccgcaacctctgcctcccgggttgaggttcaagttcaaacaatactcctgcctcagcctcctgagtagctgggattacaggcatgcaccaccacgcccagctaattttgtatttttacaagagatggggtttctccatgttggtcaggctggtctcgaactccagacctcaggtgatccgcccacctcagcctcccgaagtgttgggattacaggcgtgagccaccgcaccggctgcaaaaccacttttatttggcaaaaaaataaataaatgataagcaaagacaaactaggaaaaatacttgcaacttacatcacaaacaaaaggcactaatccccaaaatgcaaaaggcttttagaaatccgcaagactaacaacctgaatttttaaaagcgggcaaacaataaaaacatataatgcacaaaatacaaaagtccctcaaacatataaaaagatgctcaatcttacttatgagaaatatgcaagttaaacctctacggagatgctatttctcacctattcagagcggcaaaaatccaaaagtctgaaatcctactttgtgggtaggctgtggggcagaaacccctcatgcaaagtgggaggaacgtcactgcacagcctctggaggcctgtccgtcagcatgcagcaagagtgtacaggcatgtttgccctttgccctggcaatcccacttctagaactctatcccgaaatacaccgacaaaaacaggaaatgttctatccatacagccactcctggcagcactttctgtgacagcaaatgccagggaataaaccatcccagtggctggccagcccacggcagcgcacagtgcagctgcagaggaggccggggtggcccctccagcacaaaatgatgccttttgtgttatcaggggatacaaatgtgtgcctagatttgtgtggatttgccatatgctttcaagatgaaaggaaggataggctgggcacggtggctcacacctgtaattccagcactttgggaggctgaggtgggtggattgcctgaggtcaggagttgcagaccagcctggccaacgtggcaaaaccccatctctactaaaaatacaaaaattagccaggggtggtggtggtgtgcacctgcaatcccagctacttgcgaggctgaggcgggagaatccttgaacccaggatgcagaggttgcagtgagccgagattgtgccattgcactccagcctgggtgacacagcgagactgtctcaaaaaaaaaggaaggataaaccaaaaacaatggctacctttggggaaaatatatttgaagatgttgtttgaaaatgctgattttggaaaatactgaatttggaattctgtaggtgcttctaaagtaactattaagtcgaaaagaaaataaaaacattcatttgaaaaatacttatattcaaataatgcagaatcgcacaacattaatttaccagtatctgctctgaatttttcttccatctttttcttcaaaatttccatttcttctaataattctctgtttttggcttcggaatcctttagtttgctaaaataaaaaataaatggctttaagtgcactgagaagaggttgtctgtgagctggtatggggcaggtcaggatgagagagccgggatttctccccagcactcaggactgtccagaacacggtagctcatgctgggcctttctactgcaaacaccatgaacagtacgaatatttcaaatataaacattcaaacaggaatttaaaaagtcatggcttaggaaggcgtgtctcatgaaggcctaatggagctcttgaccttcctaatcttgttcccaggcgagtcctctgttcttcagggacacagggcccaggccgctcagccgtcagccccatcaatatctttcccataactggcaagatggtggctgcaccaagaagcaccagcaccacccgcacgggtagccttgcaattccagcaacttcgtgcaggggacagaggaagtcaggctgccacggggaacacctggccgggagggatgcagtttgtgggggctggtccactcatcagtggggtgacagtgggcaaatcacctgcggagtgtgtgtaagtgggagtaacaagactgcctaccctgttgggctgtgggagggtcacaggatttaacaacagaacagtcttacagcaattcccagtataaagaaagtcaatttaactgaaacctattaccattaattttttagccccaaactaacaggatttgggacttggtaattctgttagagacactgtcccttccaggtcctcgcctgcctcatggcacagcagagctggcctggtttttatgaaactgacgttcattatcgtatcctcgtaaaaccagatctgcaaagaggagactctcagcaaatactgactgaatcactgctgtgtgaaaatggcgttctcgttactgcttggagttagggaaaaatttcaagtgagaatgccatcttcaacctctgttttaaaatattcacgttagcttgaaaggaacaatcttgaattagtgaatggagcggcacggaggtgactaagcagtgagaggggctcctgtcagacagcggtgtgagtctcgctacccagcgtgggggcacaagcacccgctgccgtcaaaacacggctcgcaccgcaccacacccccccgcggcaggcaaggccctgcaccctcgcggccacctcagtgccagaacggcctgctattcggggctcctgcaggtgaacccgacgtgctgcctcctaaggctccagcaaacgccgtggccccgattttccaggcgaggagcatcggagcccgtgaggctcagggcgggctcgaggccacacagccactgctcctacctggagtcagaccctggcaccaagtacctttccaaggtgaggttggcgtccttgaccttcctgagctcctcctggacaagctgcttggcccggatctccgcctccagggccgactgcagctccagccgcgcggacatgtccagcttctggctgcggcgcaccttccacagcgggtccttgagacacggtcatggcgttaaaaatgcattttcagttatccgcttgttaaactaatgttaacaaataagttatctttgtctaaccttaagccattacggtctcatttagatattaactctaaattatggaggtgcctcaggagttttagttttgatattttatgactttttttactcttcctcagaaatcttctaaaaaataactaaataatttactttatcttttagaagaataaaagtgattctgtagtgcaatttcttttcttttcttttctttttttttttgtttgagatgtagtttcgctcttgttgcctaggctggagtgcaatggcgtgatctcagcttaccgcgacctccgcctcttgggttcaagcgattttcctgtctcagcctctccagtagccagtagctgggattacaggtgccgcaccaccatgcctggctaatttttgtatttttagtagagacagggtttcaccacgttggccaggctagtctccaactcctgctctcgtgatccaccccccttggcctcccaaagtgctgggattacaggcatgagccgctgcgcctggcctctgtaatgcaatttctatatgggtccactggaccctggacccttttacaaacctaaggtacattatagggttcggttatctttttctcataacttgaaacgttttgctatttcaccatcctgggaattatgtcattactcattcctacctgtgattaaaaaaaaaaaaaaaaaaaaaagactaaaataataagggaagaatgacagagtgacctaggatgaagcaacagtggaataagccagttcactaacatcatcctcctgttttcttactgagttgcccaatgtatgacatcaactttcgagaggtatcaaagaagtccagagatgccatcttgctgttttttcttttttaaaacaaactgaaaacctttcattgaacacaattgagaatgcttcattttccatctataacagtaaagagaagaaaatggacagaggaaggccaggtgtgggggctcatgcctgtaatcccagcactttgggaggccgaagcgggcagatcacctgaggtcaggggtttgagaccagcctggccaacatggtggaaacccgtctctactaaaatacaaaaatgagccaggtgtagcggcacacgcctgtaatcccagctactcgggggggctgaggcaggagaatcacttgaagccgggaggcggaggttgcagtaagccgagatcacgccactgcactctagcctgggcaacagagtgagactgtcgcgggaggaaaaaaataaaatacacacatcactaaatgaaccaatgaaattaataaaagcaagctctctgagggcagaatccagtcttaacttgacaccacggagctcagtgctcagtaattatttgctaaacgaatgaatgctgtcgagagaagccatgatgatctgagagctggcaaatgttggcgttccttaaattggggaactggttacacagaagtctcttgcatcactgtaattccctaaatagtacttatatgtcacatttatacttaaaaccattagcgaattattcagtaatagaaatgcaggcattacacaaaacctaccagtgttcttgaccccagactagaactcctcaaagcctcgagctcttcggtcatcttggaagcaagagcttgaaggtaaccccgggcatctttctcgtcactgaccctggaggagggaacagatgttctatctcacgaagcatggctatcagggagaagccaaacaagaaggggacgttcccgccttcctcggcacacagtgacacagtgtcacgtcagctagagtgcccgcagtgtacccgttgtatacacgggatctcattgatggatgcgtcgttacattgcacatgactgcagtttaaaaagacaccaaacttccaagactcaagaatgaaaaaattctattactccataaatatatatacctactacgcacccacaaaaattaaaaataaaaactctttttttaattacaacttcacaccttaggagcggagggccaggtcccagctcgctccaagtctccctgctgcttctgcagccgctttgggagggctctgcctcccctgtctctgagaacgcaaggggtgtgaacggtttgccccaagtccttcagtgggttggtgggggcgtatctccacctctattccaacagaaccactgccccagacatgagaagttctggggaacagcagtgagacctgcaccccagcctgagaggcacggcctggcgtggagcacaggatcaggcagaagaggcggggcagaccccatggactgagcagggagcggattcacggccgctaatggggccgcgcacgtaccactgaatgatttccgcaatctgagcttcccagtgggccactgactccttcttggctgccagatcctgcagctcatcctccagctgtctattttgagctgtgagtttatccacaaaggaacagagctgaaatgaaacaatttcaccacagaacttgttaatcgggcatcctttaagtatgctggatttaacactggaagttcttttgaagactctgaaagttttctttaatcgtcatgagatttttccaaactaagttcatgatatggatttttttcactgtatctagcttaagtcacatttcaattcaaatctaaacctaaactgatggagctggagctagtgacttcaggcaattggcatcttttcgctgaatacaaacatcctatttaaaagaccaaacacatgactccattcaaaaattaaaacagtcacgtgtagtgaaacagcaagaacacggtctgagaaacgtgtccttgcacacacagcgtgaatgcactcacgcaagcctagacggtgcggctgccgcacaccaggccctgtggtacagcctgtcaattccaggccccaagcctgcataccatgttgctgtgcgggacgctgccggcggctgtagcacaatgctaagtatctgtgtatctcaacacagaagaggtagagtaaagtacagtattatgatcgtacgggacgcctgttgtacacacagtctatcattgatggaagcatcgttatatggcacattactgcactgtaaaaagacaccaaacttcggccggcgcagtggctcatgcctgtaatcccagcactttgggaggctgaggtgggtggatcatgaggtcaggagattgagaccatcctggctaacacggtgaaaacccgtctctactaaaaatacaaaaacttagccaggcgtggtggcagacgcctgtagtcccagccacttgggaggctgaggtgggagaatggcatgaacctgggaggcagaggttgcagtgagccaagatcgcgtcactgcactccagcctgagcgacagagcgagactccatctcaaaaaaaaaaaaccaaacttccaagactcaagaatgacgacattctactcccccataaatatatatacctactatgtacccacacaaattaaaaataatttttttttaaattacaacttccacacaaagtgctaactcaggtactttgaattaattaccttttcattttcagcagttagcttcttgttttcatcaaacagcatcgctctttctcgttcgtatttatcttttattgtacctactgcctcctccatctcgttatgcctgccaaggtgagcgagaaacagttttaaaagctcgtaacttcactgatattcgtatctatggcgtgggtatcagcttgcatcttctgaactgagaagctcatgaaaacctaccgttctcgctttgacttttctaacttatcttttaacatcaagatttctttctgcagggccagctggtggctttctgaatcatgcacctccttcttcacatttttcacttctagcacatgggaggcctcacgtctgaccaattcctcttcataaaataagactttcttctccagctcggatttgattttggaaatctcttgctggtgctctaaggtggcacccgctccccggcctccttgcttcacctgaagacaaaggttaacataaattgacaaacctctgtgtcctcaagggtcacactgtcctttcaacccctttcatcccaagcaagtgcagacaccttcccaaggactgtgtgtgcctggtctacaccagatgacgtagctgacctggctaacgtgatccaggttctagggggtcacagcaggagacggccttgcagggggatgtgcccaggtctgcctgggacccccgaagctctgccccacaccctgttcattcatgcttgcagcattcttctgagggctgactctgtgctgggccccctccttgtgactggggtgacactgaggtctctgctctcttggggctggcgggaactgacagcaaaccagtaaaggggcagaggggccgtgcaccccagccaggttgtagggagtggagggcgtgccaggatggctggggcggcttctgtaaggtgctggcctattaagtgaggtgtcaggctaggggcaaagaacaagggcacaggctggagtgaggtgggacgtgttggcagtgtttgcagcatgcagagaggccagtgtgtctggtgtggcggggcaaggaggggcaggagaggcactgctgggctggagcaggcaggagggtagctgctggacagctgcggagccacggaggccctgccgcacaggaatgtgatccggctttggtctgccaagctcactctgcctgctgtgcagagaggagactcaagggctgagaaaggggcaggagcctcgggcaccacatgccgaggtccagccaagcccgctgccagggaggaacagcatctcaggcccacgtcccagaggaagagttgccagatcactgaggcgaagggagagggcagacccatcgcacgcggctcacacatgaggagatccaggccacgccatactgccaaggagatccgcctccggccccttgcccacttggccactgtggccttccccactcccgccctccgcggcctccctgctaccctccagccccaccagtgggccccgactgatggccagcctgtctcttccccagtcagcagcaggctacgggctttaaggagcttttccaaaactcaactgcaccgaatttagaataccacgatgtgaagaaggctatgaattgatggggctggagtaggaaatgagccaattagatattcgtttcctaggacttactgtgaattgcctgaaacttttatataacaaaggaaaaacatgaacttggcctttaaaaatgaaagcagtcacgaaggcaggggtcacaccccccacctctccacatgtgggtcttgtctgaacagcctcgggtgacactcggcccggaccacacattacacaaggtgacttccatgtggtggcgtcagcaaagataagcatccctctcagttaagggcagagacccccgcccagcactaccttgagggcctccagctcgctttccatttgcttgcagaagttctcgctgtgctcacgaagcttgcgctccttggaggcctcagcaacagcatcatcaagctgagcttccagctacaaaaggaagatccagtttctattaacaaaaagcgagccctgcttcaccagttacagcagcacccacgggacctccacaagaacaagacctcgaaggagctctgcgcgtgttcacccttcatcaaatcttatcacaaattaaagtttgagaaatacacttctgggttcaactgggatggttggttactaataaaacaaggttcaattctagcttaaattgacacttaaatttcaagaaaggatacatttcttgaaatttaaatttcactgattcgtgaaaaccagtacttttgatatctgtagaacttgaattcatttattaaatgggccatttcaaacacgcacacgaagaacgagcagaatagcgaacacacgtgccggcacccagcttcaacagtgagctcccgagccaagcccgcttcatctctgcctgtgcccaaaccactcgagggcaatcccaggcactgttatcacttcccccatatgtggaatgctaattcctcattaggggtatcactaacttcagttttaactgcctgtaactacaaatatatttgggttgcaaaatagactaagaagaaaacaaacaggtcctctggggctaaagaacaaagagccctgaacttgaaaggaacaggagcatgtgcttccaggccttctcatttatgggatttatcaaggaaattttaatagagttctaaactaagcatcgcttacaatatgtcaaccattcacagcagaacactcagaacacccagggcggcacagggctgcaaaccctggggtcctgagacatcaggggtgtgcaaggcccttcctttcctaattagctatctgtgggggccaggatttcttcatgtactttatccagaacggtgtagcaaaacggattgaagaaacagccatgagaactcaactgttttccattcagccagatattaaagaacagctaacaaaatgtaaaaaatgccattcttcctgccaaatttttaaagaaatagttacttttcattaaacatgttacttatgttaacatgaaatgggttttcattgtattaacaagattttgttttaatttctgccatggtgcatgttgagagctgtagcctacataagaaagctctttggggttgtaatcattccaacagtgtcgaatggtgctgagccaagacacttcagaagcactcacctaagcggcggcctgaagtgtgctgaagggttttgccatgttgctcaggctggtctcaaactcctaaactcaacgatccatctatcttggcgcctcccacagtgttgggattccaggcgtgagccccgtgcccggcccgtgatttgcctttctactgccacctgccctgtgtggactgcaggtgtcttattcacataagccaggctgcatcacagcacagcataaacaccctctatttacttaaaagggaattaaagaaaatcagcaccacaagaaccttattgtaatttcaccaatattgaggaatgagaacaacaaaataaatgctcggccgatcaacttacttggctccacagaaaatttctgaccccttttacagtaatgcagcccaagatttcaaagacgttttataaaagtcacacaaatgtccagtcgataccatccctgaaccatctccacagctacctctttcctgagcttctcagctctccgcatttcctgccgcatggcgtccaccttctgcgtggccacctccatctcctcctccttgtctcgcagctgccgggacaccttctgcttctgggcacggagctctgccatgcgctcgttcagctccgagaactcctgcagggccagctttcgctgctgatgggcatctttgagttccttggcctgggatttcaaccgctctgaggcttcaaccagttgctgaacaaaaacaattatagatgttttacgtttgcctaacaaaggcttggaaggctggaggttcggtcttccatgatattgaggagttaaaagcgacagccaatgctggttacagattagagccacagatctgagctgcttggaaaaagacctgtgctctgtctcgtgccagccacacaggcaatgggaaggccgcctgggctcaggtgctgagaccaactgcacaccaagaaaggccccacaggccgggcacagtggctcacacctgtaaccccagcacttttggaggccaaggtgggcgggtcacctgaggtcaggagatcgagaccatcctggctaacacagtgaaaccccgtctctattaaaaatacaaaaaaattagctgggcgtggtggtgggtgcctgtagtcccagctacttgggaagctgaggcaggagaacggtgtgaacctgggaggcagaggttgcagtgagccgagattgtgccactgcactccaggctgggcgacagagcaagactctgcctcaaaaaaaaaaaaaaaaaaaaaaaaaaaaaaaaaaaaaaaaaaaaaaaaaaaaaaaagccccacaaccacatgggggcagcgtgcttacaggaggacgctccgtaatgtcagcctctgcccagtgtcacctgcacagccgcaaagctgaatgaagcatttgggcactcaatctagttacttaaacataagcaaaatcaaaaagaacacatatgacacaaagtgctgaaggtgaagtcacagtgaagaactgtataaaaacaatcgctggacagcctgcccttcaatgcagactgatgtgcggatactggctgtcactctgcactcaccacgctgatgaccctgacctccctgcagccaatctggtcaactatctggcagttcagtcactgtcacacctgctggtctgagatggaagtgacaagaccctgagcaagctggcagggcagctcccacacgtgaaggggaggcctccccaggcctctctgggcccgctgggaggtactatgaccctgtcaagcaatgagatgccatgtgccccacactgcacttctagacaaatcactcacgtggatgacccacagattatcttaagaaacaatctgggtttgatacctggcacattttagagaacagatcacaaactacaggttcaagaataacatgtatcaatgaatgtattttagaaaacacgcatataattgtgttagtaacatgctgacacctgagcataaaagtttcccatatattactaaaaatgaaatttataaacgaattatggggggaaatcacccagattttaacacagggtctctgctgcagttccctgtcattactaagggtccccttctaagagcagaggcctggtggagagaaggggagggcctggctcgggacgcagcgtgtgttgccacagccaccatgccctatgcacagccaccatgccctgtggacggccaccatgccctgtgcacggccaccatgccctatcgacatctttcctcgctttagaatgcagtggggtgctgctttctctgtgggtctgaagtggagactggagaggctgattgcgaggtggataaccgctgggggcaagggggtggaaggcacctgccactgggagccaagctctgccagccgacgcgggggctgtgcagcaggcaggcgtggcaggggccccggggccaggcttggccctggcgtcctgcatgcagcagggacagcccatgggcaggagtcccaagaggtcttccatcatcggcatgaacgtgaccttacagaattctgcaaagtcccgtaagcctttctcaccccaaactgagccacctaccttgtgcagctcctccttctcctgccggaccacgcggtgctgcttctccagcccccgcagccgctgcgtggagtcctcacgctcttggcgaagcgccactgtgtcctcaagctgtcgctcgagcctgtttgaatctggacaaaagaggaaataaactctgttcctttatgtgcaatgactatatgtaaactttatgttagctgacttactgacaggaaattatttaataattcacaacactttttcattcagaggtttttttacttacacacacacacacacacacacacacacacacacacacagtgtcataggcacagctacctgcatgcctgtgctgaacaggctccctagactttactctgatctgacagcgatctcccctgagcactgggagcccttgggtggcgcacacactcgtctgctcagtccctctaacctgtgtcacccagcacagtgcctggcccttgtcctttctcagcgtgcaagaaaagttttagttagtaagtgactcaatcaaagaagtctgtttttggatcaggacagtggggttcctgataggaaatgcagagaaggtgagattcaaagtgtgctttggaggtgaaggtcaactgcagagccaacctgtgtgaggttaaggcttaaaagtgattggagccaggccaggcgcagcggctcacgcctgtaatcccagcacttcgggaggccaaggcaggcggatcacgaggtcaggagatcgagaccatcctggctaacacagtgaaatcctgtctctattttgtaaaaatacaaaaaattagccaggcgtggtggggggctacttgggaggctgagacaggagaatggcgtgaacccaggaggcggagcttgcagtgagccgagatcatgccactgcactccagcctgggtgacagagtgagactccgtctcaaaaaacaaaaaaacaaaaaaacaaaaactgattggagcttttagggaactttgataacctaggaaccgccaaaagaaagtggtgacagcaggtctagcacctacaacaccaaggagcaggcagagtcactgattaagctttaggaggaaagcagctctaggaactgtctgaaagccacaaaaaggaaaactgtaacagagaagcagaaaatagccagagaacgtacagataaaatatcaggaactgattctagctggtgactataaaataatatcattagaactaagccaattggggctgggcgcagtggctcatgcttgtaattccagcactttgggaagccaaggcaggcagatcacctgaggtcaggagttcgagaccagcctggccaacatggtgaaaccctgtctctactaaaaatacaaaattagccgggtgtggtggcacatgcctgtaatcccagctacttgggaggctgaggcaagagaatcgcttgaacccaggaggtggaggtttcagtgagctgagatcgcaccactgcactccagcctgggtgacaaaagtgaaactccgtctaaaaaaaaacaactgaccaaaatttgagaactctaaataagcttgctaaagcctaagctttttttctgctttcccactttatgaaaaggactctgaaattcccttttaagacagtaatgaccaaaaatagagactaagaagtcacacttttaaacacatacctgctattttattcttcaagcgttcgatttcttcatttagctttttgatttctttatctcggtttgaattgctgagggcccgagatgagccgtggagggactgcacggtctgggtggactctgagggatggagagacagcgtgaggtgcagcctggccgcagcgcccccgcctggccccggagccggcgctgccctcaccttgcagcttcctgctcagctccagcttctcctgttccagcctccgaatcctcctctcgtaagcttccatctgcaggctgtgctccaggtcccgctgcacatcctcatctttggttaatgtgttggactgcattatgctcttcagagagcctcgatcagaaaaacagctgggaaaccaagcaacaggtttttttgatctactgaaaatttagcgatttcattagcattttcaatcttcctgaggtgaaagatagtctttttaaatcagcaaacaaaaacacctgagataagactttatggtttatggaaccaaagttagacaagtgaccagatggtcaaggagacactgacaagggccctccccatcgctggtcaaagaaagcgcctctgcaaaggaggggaaatggcatttctaaatcatcccccacacttaactataaatgcaaaaccagaaggcatggatcctgcgtaaagcaaggcttagggggcagccccagctcgtctgcaggtcagcggtacgcatggaccactgaaagcttcctggtttggccaccaactggccaagcaatccaggacagctctttcaactcttcttcccctgcaggctaagccaccaattctagcactgaccagcacactaagccccttaccaaggaccagaccactcgatgacgcacacagccgaggcacaggctgaagcccaggatggctctcatttaatagcttaattcttgggctgctttaggagttacttagttctgcttagctctttatgtgacaatgaagtcagggaaattttgagctcctacgcagagttccataaaggcacccagccccctttagagaagacctggtcagtgtttctccacaggtggtctgagggtgctgggctgctccagccctgcgggatctgtcaagaggagagctctaggcctatctggccaaactacagccatgggcttgggacctgcaagtgtgacaagcatttggtgagctggcatgtattagaaagatcaagaacctctgcactgggggctggtaaatcaatatgcccacccagaaagcctcctgtgggctggaagacagcagctgccactttggcttatgggctgtttaaccctggcctctcacaccaaaagagatttcttccaagctcgagcagaagtatggggatatcagccgggcgcggtggctcacgcctgtaatcctgacactttgggaggccgaggcggggagatcacgaggtcaggagatcgagaccatctggccaatatggtgaaaccctctctctactaaaataaaaaaaattagtcgggcgtggtggcgggcgcctgtagtcccagctactcaggaggctgcggcaggggaatcgcttgaacccgggaggcagaagttgcagtaagctgagatcgtgcctctgcactccagcctgggcgacagagcgagactccgtctccaaaaaaaaaaaaaaaaaaaaaagaagcatggggatatctccctcccaagacattttcaactgtggttccagctgccagaggacgccaggaatcagattctgtggcacagtgggagcttccattgtctcatttcacctctctttcttcctaacccctctcctcttggccccagtttccttttaaaatcgaggtggaccatctcaggcgacacaactttgcaaagaggcccatttgggacaggggcccacaacacacaatccttacaaaagccagcagagtgctctgatggaagccagctctcagctgagtgcgcatggcaactgctctgcttgctgtggccaccgactggatcagagctaaccctgccaatgctggcggcctattggtcaggggttggcaaactacggcctctgggagaaatctcacccccctggcctctgggagaaatcctgcccgaggcctgtttctgcaccatcacgagcatgaatggttttaacatttttaaagggttgtaaaaagaagaacatacaacaaaggccatgaaacctgaattctttacgacctggatatctgtagagaaaaagcctgcaaccttgctatggtatcacctgtagtcatcaggtgtgcatattttaagaccaaaaacccatctccatctcccttaagtaatggcctcccagcgcacacaccacccactagcccgcccccagggacagactgtggtgtctgactgttcatctaccacaggggaagtgtctccctggggaatgataaatccagacatacctttccgttgtgaatgtaaaaccaatgaatggcaaatgtaatccagaaaagcctgtgtgagaaccaggaggtaatatttcctgcataagaacatatacaacacaaatgaaatctacattcaaacaaacaggtaaaaagaggaaagatggttacagtcatggtgacaggaggcactgggcagaacatgtggccttggagaatgcggattccatggtgtcctctgcaggggagatgagtatagcagatctgtctttctcaagcctggccctgtacgctgtatgtacaataaagctcacaggagacacactctgatttcgatgatgacagtggcacaggccgtcaccaggttagtgattttcaaagacttcttaaagccacagaattcactgcttaacacaactgtgtgcagagtccaacagtgtgaacaggtatggtccctctgaggaccccggacagagcctggggactctcaggttcttgacctaagacaagaggccccaaggcaaaaaggaacccaaaggtagattattttagataagtttattataactctatttttcattctgaggatctttctttattaaaaactataaccaggggccaggcacagtggctcacgcctgtagtcccagcaatttgggaggctgaggtgggtggcttgcttgagaccaggagttcaagatcagcctaggccaacatggtgaaaccccgtctctactaaaaatacaaaaattagctggatgtggcagcacgtgcctgtaatcccagctactcaagaggccgaggcacgagacttgattgaatatgggaggctgaggttgcagtgagctgaggttgtatcactgtattccagcctgggtgacagaaggagatcagtctcaaaaaataaaaaatataagcaaagttctttatctgggaaatttcagtgtggaaggagttggagtctggagtcagagtctaggacaacaatcctttcaacaatgacaatacttttctcagcattttctccatgtggtctgaagttcagcctttattttgaatgtgaagccatcaaagcaagtattcggtgcaaatagatttaacttttcttgtttttttttttttttgagatggactctcgctctgtcacccaggccggagtgcagtggcgtattctcaggcactgcaacttccacctcttgggttcaagtgattctcctgcctcagcctcccaagtagctggattacaggcacccgctatcatgcccggctaatttttgtatttttagtagagacggggtttcaccatgttggctaggctggtctcgaaatcctgacctcaggtgatccgcccacctcagcctcccaaagttctgggactacaggggtgactcgccgcacccggcccagatttaccttttccatgaccctacaaggggtacttcatagtttctaagaacctctgctcctcccactaaactactaggagtttccccaggttcatggtcattcatttccagaggtcctggggatgaaacatacagagtgaatgatgatgcttcggtgtaagaaactctctaaattaataagcaacgaagaagattttccttttatttggttaaacctcagcttgtctatccccaaacgaagtcacacatgtatgggtttgatgagaacaaaagaattttacgagatatgagcaaaattctccaggaccaaaggtactggctagtgtgtcaaagaggccctgtcagagccgactggaacaccaaacaagtcccacagctggaacccaactcggaaaatcctgatcttaaacatcagtgcggagactcaaaatctgctattatcatctttattctgaactcttgctgtataaagaaacaccaatgcagacacaaagcgctgtaatgttagaaagatttaacgtgctctcacatgtagggaaaagaccagtaactgagaggccgccacactgcctatgggactgtaggctaagcccatgtcttggtgtctttcaacctaaaaaacctaaaatgtggtgacagggtcacagtgaagctctaatacaatgatgtatgtgacactgctttgaaaagtatcaagtaggctgggcgcgatggctcacgcctataatcccagcactttgggaggcagaggtgggcggatcatgtggtcaggagatcgagactatcctggccaacatggtgaaaccccgtctctactataaatacaaaaattagctgggcatggtggcgcatgcctgtaatctcagctactcgggaggctgaggcaggagaatggcttgaaacagggagtcagaggttgcagtgagctgagattgcaccactgcactccagcctggcgacagagcaagactgtctcaaaaaaaaaaagtatcaagtactgtgaaaataaaagcaaaagtatttctgttgagttgcaaaacaaatgagctgtttaactgaattttactcaaattgagtcatccatcattttttaaaggaatattaaggacccagctgaaggctggaataaaaagcacactgtcttaagtgccaaatttcacagctttatggtgtactgacttgataagcaacgccctcaacacagcactgcatgtcagacccacagccagcaaccctgagaacggtgctttcacactcaccgtgtttctcagcacgtcgtcatccacgtcgaagttggatgtgtcagagggactgctcacatcaggaatataaggtgcttctaggtttcgtatattttcccaatttagaccttcaaaaaacgcatgctttttgaaatcctctattccattctgccccagccggcgttctctactgcagatcagtctctggatgaggtccttcgcttcttcagatacatccgtgacatgggatgggaactggaatcgctcctgcaaggggtggcaaaaacaccggtggacaggtggacgcattcagagagtttaaggtgtacagatatgataggaaacaaagtagaaatggtagcttcaaagcaggtcacttcatgggaactaaatgcaatccaaagctaataaatttccattcccaaaaggcaaacaagaaaaccagtggtccttctggttttactcattgtagacttgtgaccacactgcatgtaaatgacacattttacctatggaagtggcaaggaatgtgggaaacatgccgtgcgcgggaagagggacaggcgcagccccgtcagaatgcacagtgcacgcgtcacggcagctccgcttctggaaactcacactaaaaaagcagttactaagaggaaacacaacatgctcaggactgcactgtattttgaccaagaaaactgcaaattacctacatgcccatcaaaaaagagactcgttaaaaaagataccggctgggcacagtgactcacgcctgtaatcccagcactttgggaggccgaggtgggcagatcacctgaggtcaggagttccagaccagcctgaccaacaaggtgaaaccctgtctctactaaaaatacaaaaattaccgggcgtggtggcggcctgtaatcccagctacctgggaggctgaggcacgagaatcgcttaaactcgggaggtgcaagttgcagtgagccaagatcgtgccactgcactccagcctgggtgacaagagcgagattccagctcaaaacaaaaaagatggggcacaaagaaaaaggaacatgtctgtgtgctgctatagaaagacaccacagatacaatgacaaaaaactgttgatatgtaacatgatgccacgtatctaaacacacacatgcgcacgcacacacacgagctgaggtctgccgaggccacacaccctcatggtagagtgggctgagagctgagccaccacctctgtcatctacagaaaggaagaacaatgtcacctgcttcacggagtgcctgacccaagagcccacaggtggtcggcactcagtgactgctggcaggctcttagtaataacgaagtcccagttgttactttaacagaatttgtcactaagaagtggatgagacaattttcattatctacaatatgcatttttgcattgtctgaagtttttatagggggtatatattaatttacaaataaaaatatgcttctactttgggaaaaacgttttttaaaactgtaacttttgctttgctttggagttaaatggaaaaccagttcccgcttcagtgttaatctgctccctgtgagagcgaactgtgggaggccctggctggaggacaggccagcactcaatcaggatcattctgggatctgtcatgtgcacaggagacagcggggagggaaatgctatgagcacgctggtagagagggtgaaatcggcattaggaagacacatgactgactgggtgcgatggctcacgcctgtaatcccagcactttgggaggccaaggtgggtggattgcctgaagtcaggagtttgagaccagctttgctaacatggtgaaaccctgtctctactactaatacaaaaaaattagccaggtgttgtggcaggcacctataatcccagctactcaggaaactgaggcaggagaatcgcttgaacctgggaggcatagctgagattgcaccattgcactccagcctgggcgacaagagcgaaactccgtctcaaaaaaaaagataaaaagacaggcaggagaatcgcttgaactcgggaggcagaggttgcagtgagccgagactgcgccactgtactccagcctgggcgacagagtgagactccatctcaaaaaagaaagacacatgactaaggaaaatttttaaaaagaaataaaaaatatcagacagaagagaaaatgataaaaaggaaaacaaaggaggtggagagaggtgacatggaagtgagaaagtgaacagttcggaaagggaaggaggaaaagaggaaacaggatggggaggatgaagggctccaccatctggagacacatgatcatttacagggactgatttctggggaacagacttgagaatcaaagttggcacctaaccagtgaatctagagccacaggtcaaagggcccacctggacctccccactggctacccccgggcgcctcactccatgcgcctgtgcagacgacgcgtctgtctacagaaacctgccttccctccaggaagccagcttggagcaggccagcgtccttcccctgagagtgggggtgggggtcaccctcagaacctccttccccttcctctggcgcccacatctcctggtgccgaccccgcctctggatgccctctccaatgtctactccaatctgcctgtccccagtttggtccaaaccccgtcacctcttcctcaactactcgcgttgcttcctaacggatcttcctgcactagttgtgctctctgtactttaggcctgagccaggtaccaaaaaaaaaaaaaaaatgcaacgtcttacttcatggttcatgatcttcccataggtctccacgagtgactccgcataaaacggcgtttctccatagagcatctcatacatgcagacacccagagaccaccagtcacactcaggcccgtatttgcccatgccgtcctccatcgcctgcaggatctccggcgagatgtagtcaggtgtgcccacggccacggaggactgcaccttaggggagaaggaggtgctgaaggaaaccctagggcatctccaatcacatatttccaactactttctctaaaatatagcggaggcagaaaatgaaataatcatagaataaaactgatgaatgatcgtgttttttaaacccagtaattcaagctgagtatagtgcctcgagcctgtagcctcagctacttgggaggctgaggccggagaaccgcttgagcccaggagctcaaggccaacacgggcaacatggtccccaaccctgtctctaacgaaacaaaacggaatttaaaaacctcaataatgcaaaattcaatgcaaataaatatccttttgaagcactaaacattatgcggctcccagaatgcatgaaactcttgtacacatggtctgtcaatacccaaataccagccacagccccaaacagtgcctctccaatcccccagggttggcatttcccactctctgtcactgctcccagtgtgatgcaggggccacatgtgcacaggccagcctttctgattttcatgtgcagcacgcagggagtcttgtgtagggtctgtttttagaataaagactccagtggggcacaagaggctgcatttctaataagcttctgggggtactaaggctgctcacctgcagccgaccctgtggtcttcctcatgggaacatgcagaagttggtccaggcattagccgggtgctcaggcattccctggacagcgcaccaggaggctaagaccgctcctacccccgcaagggagaaaacagctcccctgctatctacatcagcaggcaggtgccagagtacagtgacacctctgcagaaagctgcgagggcacgggccacctcagagcaagcgggaggagcctggtgaagctgagaaatcatccaagcagagagaacgatggagagtatagggccatcctgacgggctgagtctctaagactgaggctcaggcaggaactggagacaacaaccacaggcctgtctggggaaggccaggctctcccgagggtcccctctgggaagagagacacagggtccaagcagcaccccagagccagtggtgtgagaactgctcaggctgaatggatcagcagagaactccacctctatcacttccctgcacgagtgcgtggccagcccacaggagctcctacagacagcgggaccactggggtgttgggcggtgactccacgatgaacaactactgtgacggggtggagtggaggtgaggagggtaacccatgctctggttaaaccatgacggggtggtgtggaggtgaggagggtaacccatgctctggttataccatgacggggtggtgtggaggtgaggagggtaacccatgttctggttataccgtgacagggtggtgtggaggtcaggagggtaacccatgctctggttatactgtgacagggtggtgtggaggtgtggagggtaacccatgctctggttaaaccatgacggggtggtgtggaggtgaggagggtaacccatgttctggttataccatgacggggtggtatggaggtgaggagggtaacccatgttctggttataccgtgacagggtggtgtggaggtgaggagggtaacccatgctcttgttataccgtgacagggtggtgtggaggtcaggagggtaacccatgctctggttatactgtgacagggtggtgtggaggtgtggagggtaacccatgttctggttcagacctgttctagtcactggaagactggagtggaggacagcacccgcctaccaattaatcaatatgtggtcaagactattaaaaacaagagactggctttgtggaatgaaaatgagcaaactgctttatttcttataaaacgctgtcaactgaagccagtcacatgggtgcttccactactgcttgaaaatccgccagtaggcaagaaagggattgctctctcggaaaactatttgatgttagaccttatgataagtgtaggtttcaaaaaagaaaagactccaaacatgtaagaacaaaactgcaacagtggccacagacgcagtgaaagcagtttgctgcaagcagctgccaacagggtgtgagcagagctgggactgcccccatcaggctactcggccatgacgctggtctgactgcggggtggagaccacagggcctgtggcctgagcctgggtctcctggtgatagccgatccgggggcaacctcctgttctttccctgctggcgggagtgtcagctggccccgtaacactgagcacctaggactctatttctaggtctacaacacccatagagaggaaacccctagcaggaagttacctgccccaacacaagtgagaaagtacagttacatggttaatgcctgcccacccgaccagcctggacagggccctttaaggaagaagcagggagcgccctcgatctgctacagggctggcatgcttttagccaccttgggattgaggaaacctgacaactcccattctggaaggcacacatattacttttgtaaacataaaaagcaataaagatgctttccaacttaatttttatttgggaaacaaaactccccaaacagaaaatttcaactatctccaaaatggattcattttctgaattaatatacttggtttcttaattgtacctcaaattgaaaacttcccttctgactatatgccaaacccaaaaccaaatggaaaatctccaacaaaaatacctacagtgccatcatcattcatcttcaaacatgatccaaagtcagccaggcggatatgaccattcacgtccaaaaggacattgtcaggtttaatgtctctgtttgtaaaataaacacacaaattaaccatctccatgcaacacattaggtagatcaaagcccttaactagtggtgatcagatgaataaatgctaatatcctcttgtgaacagctgtcaccatccagtacaaatgcctctgtgtgacattcagctggcatggtggcagccgaagtcgtatcactgcccctcgtttagtccccagttaccctggcgaggccctgtgacgattcctactcgtctgcccacccagctaacgagcccctcctgagcatctccttggtgccaggcactgctctccagcccacccacctatgcacgtgacaacgctgcccctgccttcatgaagcctgcacacgagctgaggtcttgcaaacacaaataggcactgctgtctcaggcaggctcacacggtgcaagctctgtgctgagtaccacggaaaacaggaatgggacaaagggacagagggacacgtgtggaggaagctggctgggggctgccacacaaagagacggcagtggccagacgaggtccaggaggcaggtggcgatctgggggaagactgctgcaaaccgccccatacccccaaaactgcactttatagatgaagacatggaagctgagccaactgcccacagttacagagcagcacgtgctggagcaggaacataaacacaggtctgtcccactaacgcctgtttctaaactactttctgtgcgctctcaaacacatgtgcgggtgcagggcacctcagagcatgaatgcttttttctggcacaataagcttacatgactcaacagtatgaatgcaaacaaactttaaaaacaaagacagacattcagcaaaagacaagtacaagcatgttcccagcggcaccacttctaacagccaaaaggcagaaacaatctaaatctctgcctccaagagaatgggtgagtaagctgggctatactcgtgtgatagacaccacaccccaatgaaaacagacgggtaccaactcccccagccacatgaatcaatctcacacaaacatgggcagatgataattcttacctcaaaaccagaaacaaaacacaaaaccagaaacaaaaacacaaggcaaaagaaactctagcatgtaacactccaaactaaaataaaatatcctcaaataaacattcaggaatacgaaaaagaaaacaaaacaaaatcccacaaacacacaaacacacacacacacacacacacacacacacacacacggccaggtgcagtggctcacaaactataatctcagcactttgggaggctgaggcaagagaattgcttgaaccttgggaggcagaggctgtagtgagctgtgattgcgccactgcactccagcctgggcgacagagcaagaccctgtctcaaaacacaaaaacacacgtacacacacaaacacacacgcacgcactagacaaaagcatgcagaaaagaagagctgatttaactcagggaagaaatagaagaaacagataaaatcttatcagaaatgaaattataagaggaccaaacaagaacaaattgaaacaaaaatctaatgaaaaattgaagaaagggaagaaaagatctagaagaataaaatgaggtaaagaaacaaggaaacgcagtcagataggaagcagccagaggctaaagtgggagacaggcaaagaaggcccaacagatgcataactggagtccctgaaagaaatcaaaacaaaacatgactaacatttgactacaatccaacagaactttccagaaattaaaaaaaaaaaaaaaaatacctgaatctagaatgagagggcccataagattaaaaaaaagaaaatatcaatgtcctcttttttgaagccagccaagttgatattgatgctcatatgaaaagaaaagccagaaaaaccctgaagagtgagctgtgatgaggatcaggcccagatgatttcaaaacacactacacagcctccctaattaaagcagtgtggtgctagtgtgtgcagaggcagagagaaaatggaatagagtagaatgtctagaaacaaaccaactacataaagaaatcaagtacaggacaaagataatacgaatcactggggtaaagatagacttaaataaattggtgttgtgacaactggagagccatttaaagataaaattagaactcttccttgtgccgtatataagaataaacctgaaatggacccaagatccacatggaacagatgaacctatatgaatgaaaaagtaaaaatactaaaaaacaaaacaaaacaacccccccttccaaaaaaaaaaaaaaaacaaacaaaccaacacgtgggttttctttttctgggagtaaggatttctcattcgattatgtacaaaaatgtttaaaaatctgtgtggcaaaaaaccacaatgaaccacatcaaaaaacaaatggcaaattggggaaaaatatttgtaatatatattacagataaaaggcaaatacttctttaagaattgggggaaaaaagccagaaatccataataaaagggtaaaaccaatgaaaaaactcacatacacacacacaaaaatacaaacatgatggtcaacatcacgagaaaggtgaaaaagaaaactacaattgtgtaccacctgtcacccatcagagggcaaaaatacaaaagtctgaaaatgcacggttggcaaagctgcaaggaaacaggcactttcatccactgctggtgggaatacaaattggtaatgtctatggagggaaacttacaacatcaaataaacctacgtatgtaatttatttctctcttgatccagcaaccccacttgtagagatttaccctgaaggcacacaaccaaaacaaaaaccaccttgcacaagggtatttatttctacatttataattgcaaaatattggaaactatctaaatgtccactcttaggagactacttgaataaactatggtagttacctatggtagttcgcagtattatgcaaacataaaaaagaatgaagagcaggccgggtgcgatggctcacgcctgtaatcccaacactttgggaggctgaggtggaaggatcgcctgaggttgggagtttgagaccagcctcaccaacatggagtaccctgtctttattaaaaatacaaaattagctgggagtggtggcgggcggctactcaggaggctgaggcaggagaatcacttgaacccaggaggcagaggttgcagtgagccgagatcgcaccactgcgcgccagcctgggcaacaaaagcgaaactctgtttcaaaaaaaaaaagaaaaaaaaaagaatgaagagctccatgaattgatatggaatgatttacaggatacatcactaaagtttttaaaggtatcaccttttgcttaacaaaggataaacaagaaaacgcctgcatggacgatagcagaagacagcagactggctacggatcctgggttgccagcggaggtgggcaggataaagaaggggcgacgcttctgagtacaacttcatgcagttttggaagcacgctaacgtcctacgtactcaaagaataaaactcaatcaacaaaggcggaagggaagtctaaaatggaaaactgattcaaaccaatgaatccaactgtatttcaaataaataacaacactgaagggggagatggggttaaaacaaaacaaaacaaaacaaaacaaatccaagtgacttatgaacacagaacttgaattactgcaggtgaggggtgcagtcccaatgagatgggggagaaccgcaaacaaacccggaatgcctgcgggcaggtttgcttctgtggtgtcctgggcagagcaattctaaagcttttttagacacatctcaggactgagtgagtgcacgtactaacggtgctgggagtcacagtttcagtaggaggaagacaaaagtctggaaagggaggaagtcaggaagttaactcatgattcctgagtatgcacaggtagacgtgtgtgtccatgagtgtgtctatacctctgttactacctctgtgcactgaggggcctagaagcaggcaaccccatagtaatgcgcatgcccagcacccagaacttggtcttcaaagccgctccccactaaagggccttgagctcttctgagaaacaacggagtggggacagagaaggtataggatgagccagaaactaagggcatcctcaaaaagtgaagaggcacagcgcaaacacaggagtcggctagaatgccaaatatgggccaatttcagcacaaaaataactaagatagtgaattaaaaaccactgggagaaagaaggatccatgtagccacactgatcacaaacagaccaatacacagggagaaaggggttgcttccttagaggagaaagccggatgacgactggtcagcatggtgggtctggagtttgtgagtcaatctgcaaccatgcaaagactggtctaggcaaaattcattaatgggtactaaatctctggaggaaattttaaagaggaagaggatatttgcatggtcttaaaagtatctccccacagggaaaaaactatatagcagaaaaatctaacaaaatcttaactgcgtgatgggtttatcaccaccaaggggctgatggatattgtacacctgtggaaatgacaccctgagaaggacacaatatagctatacacacacattccaagaggaaggaacacatcatctcaatctatcagaaggaaacatcagaccaaaccaaagaagtcttctactgaaaaagcaagggacactgtattcgccaaacacatcaatgttcttccaacatgccaatgtcacaacaaaggaaggatgaggaactattctagattaaaagagattaaagaagacatgacaataaatgcaacatgtgatcctggactggattctgtactggagggaagaaaatactgtaagagatgctcctgggtcaactgctaaaatctgagtaaagagggtatgattaagcatgagtagtgtaagtaagaattttggggtaaatgctcttggtacatgcagcttattcttagatgggtgaggaaaaatctgtacgtgtgtgtacacatgtggagagggagggggatgtatataataggagccaaaatattaacaatacgtgaatctgattaaaagtatatgggtgctttttgtaccgttcttgcaacccttgtataagactgaaattttttaagtttgaaattatttgaaacattatttaaaaagaaaacttttaaaagaatgcacatgtaatatgattccatatatatagtattttaaaacaggcaaagctgatttatgctttcagagcctcactgtctaacatggtagcccctagccacagagggctattcaaactcaaattaatgtaaattacataaaatgaagaatttggttcttttgttgcaccagccacgttttgagtgctcatgagccacatgtggctggggctaccgtattgagcagtgcacatctagaacattctgtcactgtggaaagttctgcatagcactgtgggggggatgaggggtggtgacccctggggagggagtgatgggggagccccaagggggcttatctgggtgctgctgtgagcgtgcagttttgaacaatccactgagttgcacccctcggtttgggagctttactgaatacctgtgacatatctcagtaagatttacataaagaagtcaactgaaatggactttaaagttacaaaaagccctcctatcccaactacagataacagtgatttaaaggatgtttttgctgggacccagaaataaaacagccaccagttataaatggcagacacagtacctgccatgcataaattgtcacaattgaccctcaggccagccagtgtggtggggtagagacggtgctcctctcgttacggaagaggcagctgaggagcagtgactgctgccgcctcccagcctgcgctgacagcacagtgacatcacgaatgccagcacctgtgctcacgtcacacgctgcaataacctaagaatccactcaccgcctcaccaactgtttcagcacatcagaattcaaaaacaatttttgtctcacattactttagcagctttgacacaaaatctttaagtctgaaagaaaaaaatcaaaaggaaaacatctgctgaatatacatatattcaaaaatatatatattcaaaaaatatatattaaaaatatatatattcaaaaatatatattaaaaatatatattttatttatttatttatttatttttgagacagagtctcactctgtcacccaggctggagtgcagtgacacaatctcagctcactgcaacctcttgactccctgggttcaagcgattctcatacctcagcctcccaagtagccgggattacaggcgtgcactaccacgcccagctagttttttgtatttttagtagagacagggttttgccatgttggccaggctggtcttgaacttgtgagctcaagcaatccacacacctcggcctcccaaagtgttgggattacaggcgtgagccactgcacctggcccatctgctgaatatattattttcactaataaaaatcctcttttcttggaagtgtctactatacatatttaaatacatctcaattaaatttgcttcagaggaacaaattcttcttcatacgttatatatactacgttcacttcccaacagactccaccagtgttgggaagaaaggcaggtatctgcaactctgaaggctgtgtgcacagggcatgccgcaggtgggttctcaatgagccgctccacatgggatgcgaggcttctggccaagagcacgtctattaacagcacttttggggacatctaacagactctcccacgtccaccagtttttctgcattcttttctcatgaaaaaagagtgaaaggcagaaagagagagggagagttggaaggatgagaggatggaaggatggagggaaagagggagggagggaggggaaatgaagaccaacactcctggaagcagaagcagacccagcccttcccctaccctccccatgaccagggcactcagaagcgctcactcgacctcacaaacttttcaccatggcttcctgcctccactcccttctgtgagtcacccatgtaaataaaagatgaccagttttatgacaaggaagacttgaagcaatgcatacaggacaaatgtatgaagagaagctcaaggaggttgtgtaacaagctctatacctggctgccgggaagaaatggattaaagacaaggataattacactactttatttagactggaacaaactggttcttctccccaaaaatctcatcatttaggcttaacttttttggtttgggaatggaaggcagggcaattcagagaaatggagaaatgattatataggaaaatgtttaaggcaaataaccataatttcacatacacacgaaaaatgtcccaagtggcctgagacaggctaggaagacacagaagagagtaaggaggcgccgagacacgccacaacaggtgttctatggaccgagttagcaggaatgcaacgaccagagtccaggctaaacaggacctggttgccaggaattccctataaaacagggatgtttttccaggggccaccccaggaccaccaacacagtacactctgagaagacaggccgaggaggggtctccggaaggccatcttccttgtataccttccaggggccatttgcacgcactgggggtcatctgcgccgtataattctgtatttaaaacatgtggtggtggttgattttttttttttaagtgaacttgctgtttgtgtgaggaaagctctcctgacagaagagcactggaggttcagggcaagggctgacctatggctcccaaccgccgaggcctttagatgggcagatgcccaggccaactgagagagctgacggtccccatgggccactgtgctgggactgcctatgtccattctcctctaatggcacagcggggagcagcggcgtcttcaggggagagtcaggcacagcgctgagaagcagctctaggctcccccaagtgcattttctcccagctgctgagattctggctaaaatcagtggcatccagcaggtgtgggtgaaagagccatggtgaattgcaggctttatgtctcccttccagctcttcctctgacactgaaaagggaggctgcttctgtccctcaccgtaccatttctgagtgatgtcaactcccacttccatccgttccccttgtggaacttcctgctgcaaaaccagcagaggtctgattcccacagcaggtgtgcctcagcctccagagcacagtccaccacctggggtgtggctccagagccactctgaccgccagatcttctctccgaggttttcttttctttttttcctttttgtcagatttcctctacttcatcttctgcctcttctactcaactttctactttagcttttattttccaagactttttgttttctacatattctttttcttaaaatttgtactctgttcttattttgttcatacactatactctctgctctctctttagggatgtgatgttctctctctctctcttttttttttttgagacagagtatcgctcttgttctccaggctggagtgcaatggcgcgatctcggctcactgcaacctccacttcacgggttcaagcagtcctcctgccccagcctcccgagcagctgggagtacaggtgctcatcactaagcctggctaattttttgtatttttagtagagacaggttttaccatgttggccaggcaggtctcaaactcctgacctcaggtgatccacctgcctaggcctcccaaagtgctgggattacaggcgtgagccactgtggccgatgttctctctctgaaaccctttgtgtcattcatgatctctgcctttccggatatcatcaggggctgacctctcaggaaggagctgtacccacctgtgaggggcacccacagggtcctggtctgccactgatttcctcacccggaaggcttttggggtccagctgcggaaaccaggcagcagctgtgaaacctgcagacccccgcctgcggggtgggatccccacagcacccgactaaccccaggaaggggcccaagcggcagcacagtggcacgggctccaaaccatgctgtaacgtcagccacgccgtaaagttggccacaccgtaacatcggccagcggcaccactctggcgccaatgacatttctttctgaccctaccaaatgttcacaatgcccccacctgagactggggtaagacaggcctcctagaaaaatctctgttctatttttagattgcatctgggcactcagtctgaataatgagttaatttggggggaaaaataaagttttaaaattacatattttgatgtctactatgcccggacgtcaaacgactgagcaaagcttctacacagccaattaagagaatgaggatggctcacgcctgtaatcccagcactttgggaggccgaggcgggcggatcacgaggtcaggagatcaagaccattctggctaacacggtgaaaccccatctctactaaaaatacaaaaaaattagctgggcgtggtggtgggcacctgtagtcccagctactcgggaggctgaggcaggagaatggcgtgaacccgggaggcggagcttgcagtgagctgagatgatgccactgcactccagcctgggtgacagagcaagactccgtctcaaaaaagaaaagagagagagaatgaggagaacgctttctatttagggggagaaaaacaatttaaaaggtggtcaaactaatttccctggagatctgtgataaatacaaagacatttatttctctattgtgaattaagttctaccaagaagacagtataaaatctaaatgttaaaacctatactaacttatgggccgggggaggtggctcatgcctgtaattccagaactttgggaggccgaggtgggtggatcacctgaggtcaggagttctagaccagcctgaccaacatggagaaaccccatctctactaaaaacacaaaattagttgggtgtgatggtgcatgcctgtaatcctagctactcgggaggctgaggcaagagaattgcttgaacctgggaggtggagattatagtgagctgagaccgctccattgtactccagcctaggcaacaagagtgagactccatctcaaaaaaaaaaaaaaacaacctatactaatttataaaagcaagcataactatgttaagaaatgtattttttaaaaagaaagaaagagaaagcaatgtccacaacctcatcacactaaatgagtgtctgttctatcgggacagctccctgtgtgctgggaggtgcgagccatcagcaatgaggctaaggaaaggcgcccacctctctagcctcaacttcctcctctagcaacgaagcagcactccagcaagacggaagagctataactcagcagcgcccttgctccccacacaggaggggctgtgtctgcttgggaaagcctcctgatcaccacggagggggcccgagcacaggcctacagctcagaacacaaagccatggagaccacaatggcctcacacctctcgagagcagcctcaaggtggaagacacagacacatgtgatgcctgcgaagtcccaaggggaaagtggtttccaactaaaatctccacactggataaagcaccagtcacagacacacatggaataaaggcactgatttcaaaaaactctctcatataccccccttccagccaccactggaggacacgcgctaccaagccaaactaaaaagccaagaaaaagaaaaatgaacggctcggaaaagctgggagccagtcccagaaagggagaggggatctctgcacttgaaaagccatctcagaatgagtgcagcacaggacaaatgaggaaccaacgtggaagagaggaggggaacgatggaagggacagcgccaaggaaaaccagatcgagactacccgatgcatgtccggtacggagcttcataacgtggccacaatatctggggacaaattagtgacagctacaaagaaaagctaataaaaagcaaggcaattatcaactccagagaaagcagaagtttatgtaagtgtagttctcaactacaaggctgctgtcatagttacgcagtcacagtattatcaacaccaaatgctgactgaaccatagctgaaaggatggattttaaccattctaatcaggatgacgtggagccgggcgcggtggctcacgcctgtaatcccagcactttgggaggccgagatgggcggatcacttgaggtcaagagttcaagaccagcctggccaacatggcgaaatcccatctctactaaaaatacaaaaaaattagctgggcgtaatggctactcaggagcctgaggcaggagaatctcttgaacccaggaggcagaggctatagtgagtgaaatcacgccactgcactccagcctgggtggcagagcgagactccatcctaaaaaatatatcaaaataaaaatgaaaaggatgatgtgggagaaaggaagacagtttggaagtatatgtgagagagatgggtgacagagagaaagaggtaattatgtaaaagagttaaaatttcaatttcatagatgtgatctaaagccaaaaaagaaaagaaagaaattagcaatataaacctgtgacttaagacacatgaaggcagatgctggaaaaataattttacaaatttacaatagttacctgaccaagtgtaatcagcggggccagggctgggcttggttttggttggaggctctatagaactgtttgactttttaaacctattaccataaaattatcttgtaataaaaatacaagtaaaactagtttttaaaaacaacgaaaaccaaaacaaaccacaggactgaatctttgagtctcaggacaagagggatgtgaagatgtggactcagtggctgagtcactggggagctgccctcccagccgagaaggcagagggggcccctgagagcaggagacggagctgctttaggcctctgccccacacgctctctcagctcaactcctgcaagtcgcagtgatggaagcctcttcctcaagccctatttcctttgtgagtgtcctggggcccttcaggggtcagcacggcacagagaagaccagagttgagaaagaatgtggggacagagggccccaggccccacacgagacatttcagggtggtaaggacagaggaccctgagccccacgtgagccccagggagcacaggcattttagggagggggtcttgggcggtagagacagaggaccccggggcccacgtgagccccagggagcacaggcattttagggagggggtcttgggcggtagagacagaggaccccggggcccacgtgagccccagggagcacaagcattttagggagggggtcttgggcggtagagacagaggaccccggggcccacgtgagccccagggagcacaggcattttagggagggggtcttgggcggtagagacagaggaccccggggcccacgtgagccccagggagcacaagcattttagggagggggtcttgggcggtagagacagaggaccccggggcccacgtgagccccagggagcacaggcattttagggagggggtctcagacggggagaagttgagtcaatgtcaaataaatatcaaaagacacagtggcttcggctgacagcagaccatgacaactgcaacaatgagagctgggatccaccggctgctggggctggaagacggtgatgtgggcaaatcagtctgtgctgcggcagctcaaagtggggactcgctacctacatggcttcttgggacggcctggacttgggagctctgaaaggagtcttttaacaattaaacgtggtttccataaaatatatcagaagccggttacctgtgcacgtaatgaagctgatggatggagtcaatggccagcaccatttcaccaatgtagaacctcgccatatcttccggaagcttgtcttcaaatttgctgagcagggtcagtaaatcaccacccacatagtaatccatgactaagtactacaaattggaaagagaaggggagagaataccacatttagtcaccactaaacctgacagttacaggccagtcttccatggcgaggttctcaggctccaggtctggctcgtggcatctcagctgctcttctgtcacccaagaccctccttctggaacatgcgccccgatgcgtccacgacgccgccatcttcaggggtgcatatggcagagagtggacttcagtaagtgatgtatttaatcaatgggaggaatgatgaaagggcttgaggttggagagggcactctaaaagctagtgacccaaagcagaagcacagttaatagcccatcaatcctatgggtttaaaaataattctccaggccctcatgttatgtgaggacgacaccagaccagagaagggaggcaaagtagttaacatcacacatggtatcagcagttcttattggaaagattatatcataaaagagccgaaagataattacttataggttcactccaacagaaacctcagaaaagctcctacttaagtagaaattggagtaatgggagaaaaaacatctgctaacagggctgagcccgtcacttccccgcgagttccctcgccaccgggccagccgtgtgctgggagtgggcgaccccgaggtgagcctgcgtagagctctgcctgaggacagcctgtctcttgcagcactcagaaagctcagaccacaaagcccacagtctgtggaggccccagtggggagatctcacaggtcagagaggcccaggacaggcaagaccatcacagccagagtcagggtggcagccaacacctccatctctggggccgctgtgcctcagtgaatgctggggaagcacgtggcctgaacctcacaggagccgccttccttggtgcaaatttcctgtgaagagatggatgctgtggtctggacagctagcttttaactaacccgcacagggagtaaacgccctgtttatcagccggggcagggaccctgtaatatttatggagaacctaatcatatcagctgctgtcaccatgaaggcccacgctcgggcccaggctgtgagacacaggccagtgctgtcctgttcacgctcccacctgcccttgcctctggcaccaagaccccatcgacacgggaggcttggggatgggcccggggtctcccagcaagcaaggacagagcaaagacctgggcccaacagtcagactccacgcccatcacattcaaccagactgcagtgtctccaaaggaagggaagcaccacaccggtgggcttgtctgaggaagggagcggcccagctaatcagaggaaacgacagaagccttcattttaggtccctgctctcaacagaatctttaccagcaaactctcatcccttccaagcctctccacagctgtcccaccctgtggagtcttcctcaagcctccctgccaccgccaagggcagccccagcctccccgccctggctcaggcactgcccgtccttccccgccgagtttttcaatttgttcattcgctcgtgcaccctcactgtggccccgccagcccctctggcaacaggggtgctggcatgcacgagacagcgaggtccctggctcagcagagctcacactgggggcgggagagaccgtggccagcatggagagcaggcagtggtgagcgccagctgaccgcaggccgcctggtgaggtgcccaggccagaggttgccaagcagaggcctgaggggagccgcggtcgtgctccagatgaaggggtgcgtgcaaagcggctaggaggaaagtggcagcggcaccctggagcctgccaaaaggggagggccggccacagtgggggctgcagccccacactcagagcagtgagtgggtgatgttccccagctacgttcagaagcccaggcaccgaggtgccactgcgtgtggagggcgatgcagagggggcggtggatgcacactgcaggcattccagagggagcggccccggcagctgacggacacacacggggccaggggagatgcggtgaacgaacggccaggccctcgggcccctaaggaaggccgtggggtcgagtcaagcccttactagctgagccccagccgcgtccacgtctgccgagaactctaagaggaggagcttcctacagcagcactgggtctgatcaacggtctcctggagcatggtctctgaggaaagctaacgcgggagctcgtgaggcagacggcggaggcccactccagaatgagaatcagacctagtctgtcctgtcacagaacgcggggtgctgagttaagccagtaagttttagttagcagtcaaacaggtttaattttgataaaactctgtgagatagctccaatagaaactgtagcagaacccgctctgtgggtggtcagaggaacccacgtttccatatcgctatgagaggcacctgacaccagcctgcactcgggccagcctcacaaccataggaagaggaactggcctaaccctcaacgcccccgctcaaggtggcaggtgtgcaccgcagaagccggccccgcagtcacgggccagaaagcttccaaggcctcgccttcgttttctcatccttaattttcatggtacgtctacctgggcaactccaaaatctcaagaacatggaatcttcacaggggctcctaactgacgtgtgttaacttagaataaacctggcaacacctaacatttcagatggcagcacgctatgctaatttaaaaaaatattagaaacaaaacaagcatcatcatcttcctttgtacagatcccagttgcctgtactccctggaaacttcactcagttcttatcgaaagtggaaatgaactggagacagtccaccggggtcctgggagcagggacactgagcaggaagcgggggggtttatgtggaggtggccccagagcaggggatccggaacctgctcgccaggctggggctgggtcttggtcacaggtgctgtcatccatgtggtcactttgggcaagtgacttcgcctccctctgccccagacacccccttatgaaacagtggaatcactgggtcgttgggaagacggacggggacccctgtgggcctgaaacatcctaagtgctcaacaaacaccagctgccccctctgctgggcaaacacatatatataaagtctacataagtacacatttttccctaatcctgggtgttcaaatctcagggctttctctgatgcttcaagggctcctttagggtgaatggaaggatcccacactactccatctgctgtgaaccaatggagcgcacaacccaggagcttcaggtggacacgcacgttggctgccaaggaaaaggaagcctcgggtccctgctctgaggcttggtgaccacagcgaccacgcccctctcgccaccactgcagaaacagtgccattgggaatgagttgggctgagacctccttctctgaggtctgcccgcgtcacgtccacccagagctccagcagtggacactttcaggttcaggcaaacctagagtcactctaggaataaaaagtcctgaacaaggcggtctgcgggtcactcagcggccaagaccaagggctggtttccccttcaccgccaagtcagctgccttagagtgccgtggaggcgaacacgcttgacaatgcacatgcatgtgcgtcacgaggctggtccatctgtcctgaaagcaagccctgtttaaatcggaaaaatacacaggcagcgtggagactaagagtcacctaaaacctgtcgaaagggcctggggcaccccccccaccgcgggaagacaggaggactgcaggcccacgagaggcactcccggactcagccctagctgagatggaggcaaaaacatccacgtggcttaatccccactgcggttccttattctcaataatccaagattgaaagtgtttcaaactcccagctgatttaaatgtaataaacccagcaaacaaacgaatcagcttctctagtgattagaaaaaaacaaagtccttacttccacatgtgtattttaaagaagttctacctgacaattactgcatgaaaacaagccccgccgttttatcgagtccaatacacattttttaaatgtcagttccacattgtctgactgaatttttagtgacagcataaaggaataaagccggagcgaatgccctgaccgagtctctggctgtgcgacctaccaggtggttctcgtcctgaaaggcgtagtgcagcgcggtgatccactggcagtcgccgttcaccagcacatcgcgctcctctcggaagcacgcggtctgcaaagcaacgaggggtgtcagtctgtgttcactgggaagcaggccagagagcgtactgccggtctcggggtccctcctgggacagtggctccagccacggtgtccctgccttccgggctcctcctcgtgcaccaccccgaggctgctgaggctgagccatccctcatcccttcctctcccaagccccgtgcaagtgccaagggctgctgaggaggcacttgcaccctgctgtcccacgggcaccatttctgtggctgacacttagattcaccccacccttatgtggattcctgactgggctcctcccacctggcacctcctgactcctctaccagatcaacctctgccaagtatcgatggcatgggcagccccacgtgtctgccctctccgtcctatacccactactgagctgctgtgcagctggcagaaggcgcacacgtttgctgaaatcacagtatagtgatgacacaattgtcacagattccactagggaggcctacagccagcagcacagggcaagaggctgccctctaccctgctacgtcttccaaaagagttttaatgcccaggtggcatctccgtttaaaagtcaccaggcctggccgagcacggtggctcacacctgaggtcaggagttcaagaccagcctggccaacatgatgaaaccctgtctctactaaaaactagaaaaactagccaggtgtggtggcaggtgcctgtaatcccagctacatgggaggctgaggggggagaactgcttgagcccaggaagcggaggttgcggtgagccaaaattgcatcaccgtactccagcctggacgacagagccagactccatctcaaaaagaaaaaaaaaatggctggtcacggtggcccacacctgtggtcccagcagtttgggaggccgaggtgggtggatcacgaggtcaggagatcaagaccatcctggctaacaccgtgaaaccccgtctctattaaaaatacaaaaaaattagctgggtgtggtggtgggcgcctgtagtcccagctactcgggaggctgaggcaggagaatggcatgaacccaggaggcggagcttgcagtgagccgagatcatgccactgcactccagcctgggcgacaaagcgagactctgtctcaaaaaaaaaaaaaaagtcaacaggcctttggcataattttaacatgatttcctctttattgagcacagaacaagattcaaactgtcttacatttgaacttgtcaagcttaacaaaaatataagtacattacggagagcttgctatgtgaggcacgagggcacagttctgaccggctctcagctgagtctcacagtgacctctgaaacttatttcttctacaaggttttcttttctaaactttaaaaagttttcctttcaggctggccatggtggctcacgctgtaatcccagcaccttgggaggccaaggcgggaggatcacttgagcctaggagtttgagaccagcctgggcaacatagtgagactccgtctctacaaaagaatcttaaaaattagccgggtgtggtgtcacccgtctgcagtcccagctactcaagaggctgaggtgggaggatcgatgagcccagctgagatcatgccactgtactccagcctgtacaacagagtaacagagtgagaccctgtctctaaaacaagaaaaaaaaagtttttctttcaaaatgaaatggttggctgcacacggtggctcacgcgtgtaatcccagcactttgggaggctgaggcagacggatcgcgaggtcaggagttcaagaccagcttggccaacatggtgaaaccccgtctctactaaaagtacaaaaattagctaggcgtggtggcgggtgcctgtaatcccagctactcgggaggctgaggcagagaatcgtttgaacgcaggagaccgaggtcgcagtgagccaagatcgtgccattgcactccagcctgggcgacagggagagacgtctcaaaaaaaaaaaaaaaaaaaagatggctgttgcagctgtgtcccagttctactaatgacaacatgacaagcggtcaacattcagcttgctaatgtccagacatgcagagaccagcaattctggaatcatcacaacccctctgccaacagccacctcagccacaagggcctggtgaagggacaactaaagaaaacctgagcctcagtgtgcctgacctcctgtcttccagaacgcgcccccaaaaagaaatggtgatggagtgctgagtcccaggtgaggtgagaccgtgggctcaggaggccggggctgccccgaggatctgcggcacctgtgccaacgcctccaggagacgctccctgaagctctgcctggcagctagctgcccagagcatttaggaaaaacccattcttaaactggggactgcctgcaaggtgacctgctgacaggaaacttatgtattatccagcagttttgtttaaggagcagagagagaaacttttagtattttttaaccaagtaagatgaaataaagaccttgcctggtagaaaaattataaactacactgcttagcaactcttctactgaccaacctcttaattcatgcttttaagaaaattttttataaatcagtattataaaatttaatgcttaaaataagtctatgatataaaaataaaaagataaattatttgcaactagcaccatatttatttttatatctcttacacacatatactctagtataatcaccgcgactggcaaacattcttgagcttttctgagcatgccaattaaactggatctgtgtcaccagattcaaattaaatcagcaatatttactctttttaaatgtactcatccaccatgacatttaggtaaataccaaacacctgatacctctctacactttcatgtaacagtagctactttttcccctaaaaatttgctccaataacattcctgtgtttgccactgtttggggcggggaaagggctgctggggctgagggcaggcccagcggaagcacacagtgagatgactgagtgaagatggaggaaaagagagcaaaggcttctcccaaagaaggaagggagaccgtgtacaccccagaagctgggagacccagggggccgaagcaatcacaggccaccgacattttgagaccagggtaactacaaaatggtgctaactctgtcaaccaacacgcgttcagtgagcaacaaatggttgtgagaccttgtgctgggtgccatagcagggaaaggggaaatgggtgcagagcgggggagggaaaagccagaatgactgagtcacgaggaaccgataacacccaccaagttaataaaacccagggccccagagagatctggcccgaatcgatggttgtactgttgtcggcccaaggtggcaaccatcatgggcagcacaggcacaaattccaggaccaaagaggaaagcgtcacctcaaattactagaagggtgagaggagtaagaggagagggtctagaaacccaagaaggacttcccaaaatgaggaggtggccacgtcgagaggttcaactccagaagcaagcgctgaccgcagggctgagcagcctagagccaccgcagcgctgccaggcacaggcctcgctcagggcgggtcagagacacacggggccacagcaaaccattgtgatgaatggcagcctgcaaggaggggactgccaagtgccttctggcagaggcgggagtcacgggagaggatggagcatgatggacggagcagatctgaagcaggaagcaggtcaactggccaggaagggcctgggctctgagtgcaggggaggggaagacaacagggcgggtgaggacagaaactcaagatggccagagaggaaaagcgtgggctccccagcaggcctggcctgccttaggcaggcaggagggagaccaatggcagagcacgcggctgtagaggtggggtcagaggcatggaatggccaccaagaagactgacacggaactaagaaaaaggagctgatcaaagcctgctgggcagtggtccacttcatttctaatcgtgaggatcctctaggtgggaatctaaagacctattctgtatgtgagcagggtccaaacgtgttaattccttttgtgtatggagcagaactgcaatcaatgctgaaactctcccgatgctttttatttgcctttacagtaaacaggacccgccaacattctcgagggtgcactctcaggaacagtgtccagcaagcaagtggtcgctgaggcggggagcagcaggcgccagggaggagactgagacctcctcaaaagagagtgctcgctctgtccggggggcagggaggcccagggctgtggggtggctgcagcttttccccagctggcttcacagtcactttctgctcaccccaagccccatttgtatggcttttcaagctccatacttacctctgctcttttcagcatctcccacttgttgaggattttcattgcataaattcgttcagtattcttcattttgacaacagcaacctgcagtgcaaatgtgagttgaacaaagatgcggttcttgaacaaaaggctagcacgctggagctaaactgtagtgaaatcctaacagcccaggagcctgtgaaaccagcagtgaccgaaagccaagtttcccacctagcatgtgccagttcctgcatcaagaaccttttcttcacagagaaagggaccggccacgtgggctccggagtttcactcctgcaaattcacccctttatggctcgggttccaccactacaggaggttaatggcaggaccggactcctgagacacctatgaggacccatgagcactgacagttaatgtgcccagcacactgtggggcacagtcagcactcagcgcgcggccaccagccacattctttaaagaacaattcaagtgccacctccttcaggaagtcctcttggactttccagtttctaccaaatcttgaataagctctgccatcactaccaacacccgtcaagatgtctgcaccattgtctggtgcattccaccctacgtaagtcactcacacacgggcccaagtctccaactcagcacttcctgtaagctactcactggcagtgacagcggcttccataccttctggctgccaatggcaagcagccagcatgtccccgtgcctgcagcagccatggcctgaagaggtcttaaatggcagtatcatctacctgcctgtttctaacatcaaataccacacagtcacatcgtagagtcactgtgagagctgccattcaccaggcacattctgcgtgccagagacggtgttgagccgcgcatccgcacccccacttcaccctcacagcgaccccagctgcgggggatttctaaaatccatcttgtacagatatggactctgaggctccaagggaacaagaccaaggagggaatccaagaagcaaaggccgcatggaaaggacaggctcccttcaatcagaggagctcaaaaagcgatcaatgttatcttctttgaaactcacacaaaactgagttttgcattaagtttttggcaaaaaagagtactaaaaataaccgtaaaccattctgttaaaacaattttctctctcattccttcatttcccttggtcgtctctctgccctggtgtgcctctccctccctcctaaatgcattctggaaagtcctgccatggctgaagggctctgtgtggcctgggccctgctcacctccaaagcccccatgcctggcacagctcaatgcttggtagcagacagacaggcaatcacttaatgcaatctgtttttacttttaaaaggctttctcaactaggtacagtggctcatgcctataatcccagcactcttgaaggtggaggcaggacaatcacttgtgcccaggagtttgagactagcctgggcaacatagcaagatccctgtctctactaaaaagaaaaaaagaaaacaactagccaggtacagtggtgcatgcctgtggtcccagctacttgggaggctggggcgggagggttgcttgagcccaggagttcaagatcagtctgggcaacatagtgacaccccatttctacaaataataaaaaaaattagccgggcgtggtggcacatgcctgtagtcacaactactcaggaggctgaggaagaagggtcacctgagcctgggtggtggaggctgcagtgagctgtgatcatgccagcacactccagcctgggcgacagagcaagaccctatctcaaacaaaataaacaaactctctgtcccatcctggcctgtggtaaattgactttggctggtgaggcctggatccagggtctgtactgagataaactgggagctccgggcacgatgggacgagccttgcaggggctgctctcctcccctatccctctggtgagactcactcatggggatggtgctgcgagaggggggctatttccctaaagtactgatttgccttctttcacgtctgcacactggaaaatgcacgccctgcacagcaaaggccatctcgctttgtagtggtgtccagtaggtttgctgtgggcagagcacacctgctgctgggatgtgacacagggcgtttccttgtttgatttttcctcagtgaaccaaaaggcacagttccccagccaaggagagcttagatcaaacctcagcataggtgctaaggcactgcacagtttaagaagcaaaacttggccaggcgcggtggctcacgcctgtaatcccagcactttgggaggctgagatgggcggatcacgaggtcaggagatcaagaccatcctggctaacacggtgaaaccccatctctactaaaaatacaaaaaattagctggcctggtggcgggcacctgtggtcccagctactcgggaggctgaggcaggagaatggcatgaagccaggaggcagagcttgcagtgagcggagatcgcaccactgcactccagcctgggtgacacagcgagactccatctcaaaaaacaaaaaaagcagcagcaaagctcttccggtgactcactgtcaaaccacccgaggcggtaccgcggccgctgagggagcctgacctctcccttggtcttggcagaactgttctgcaaggccgaggcaggtctgtggagatggcctggaaggcgaggccacaccgtgccacgggcctcctggggcagggctcccagccccatacaagggacctggtgagcctctccagctgcacctgcatgactggccctcctcccctaggcaaagccaaccggacccagagccacaccgcgtgtgtcaacagcaagcaagtacagagcatgaaaacagctgctattcgaccctctctgtgttttttagaaaatgccaagaagtcaaaattcaattaacaaatggagttttagaaactacgtcagaaggctgggcgtggtgactcacacctgtaatcccagcactttgggaggctgggcggggcatctgggcaggtggatcacttgaggccaggagtttgagaccagcctggccaacatggcaaaacctcatctctacaaaaaatacaaaaattagctaggcacagtgtcagcacctgtagtcccagctactcggaaggctgaggcatgaggatagcttgaacccagaaggcaaaggttgccgttagccaagatcgcgccactgcactccagcctgggtgacagtgcaagacgtccatctcaaaaacaaaaacaaaaaaaactacatctgaagaaactatttttggtcccaacaatctcccaggtcagtcagaagctttcgagtctcctttctcttcattctatctttcagattttctccccagctccttgggaggccgaggcggggagatcacttgagcccaggagttcaaagccagcctgggcaacatggtgagacctcatcttagaaagagagagaggaaaaaacaaactctccaaataatactaattacctcatccccaaaccaatgtataggtgcacaaaaaggtgaaatggaagctgctgatgttttggcaatttaggcaaagttaacaaaatgaagtttatcttacctcaccaaaagcacctcttccaattactttaattatttcaaagtcttctcgatgaagctgcatttctttcaccagctgtgtaaatggtttagctacaagtaaaacagtaaaaccaacaatttagtctaatcagttcatactatataaaaatttaattgagtggggtgttgcactaagttatacttttaaaaaagtttgtttgaaaatatttaatatctgacatgttttggaaagtgagcacttataccaatggacacagatgtggatcctgagcaactgcagccacgcactgggtaacactgttgcagccacgcactgggtaacactgttgcagccgacgacggaccacatacagaacagtgatcccacaagatttatactactgtatttttaccaaatctttcctatgtttagatacataaatatggccaggcgcggtggctcatggctgtaatcccagcaccttacgaggctgaggcaggaggatcacctgaggtcaagagttcgaaaccagtcagaccaacatggtgaaatctcgtctctactaaaaatacaaaaattagccggatgttgtggcgggtgactgtaatctcagctactcaggaggctgacacaagagaatcgtttgaacctaggcgccggaggttacaatgagccaagatcgtgccactgcactccagtctgggcaacaaagcaagactccatctcagaaaaataaataaataaaaatagacacacaaaaaccactgtgctacagctgcctacagtgttcggaactgtcgcacgctgcacaggtgtgtaacccaggagcagtaggttgtgccacatggcctaggtgtggagtaggttttgccatctgagtctgtgacgtgctgttgtcatgttcgcacaatgacaaaaaccacctaaccatgcatttctcaggaggtatccccatcgttatgcaacacacaacagtatacttcagtatctatcatagcaaacatcatcacacaaaagtctcctagtcaaagccaataggtgaacacctatcgagagagcaactgatgggtgcccaaagcccacgtacaggacacaagtgcgtgaggtgagtgagagctgagctccacctgcctgcacgcaggagccacggggcagctcagggaacacaagacattctccaaggcaacacaagtgctggagtctccctggacacccatggcggtcccgaataggtcctgtggcgtctgtaacagtaatgtccaccagtcaggcaccttacactgctcttcccggcctcctcacgcggactctctgagactaattctgttattatccacacttcacagatgagaaaactcagccaggtttctgtgggcactgtactgggctggatagtgtccccagcaaaactcatgtctgctcagaacctgtgactgtaacctcatttggaaacggtccttacagacgtaaccaagtgaaaataatggcacctgctggaatagggtaggccctaagtccaacaagactggtgtccttctaaaaggagagaagtcagactcagacagaggtaaaaagagccaagtggggatggaggcagaggcgagagtgatgcggccgcacacaaggagcgccaagcattgccagcacccccagaagctgagcgttccccggagcctgcgagggacatggcctggctgacgccctgcctctggacttctggcctccagagctgtgagataaatatctgttgtttaagccccccactttgtggcaactggttacatcccccacaagaagctcctagaggccaggcgcagtggctcacacctgtaatcccggcactttgggaggccgaggcgggcggatcacgaggtcaggagatcaagaccatcctggctaacacggtgaaaccctgtctctactaaaaatacaaaaaatttagctgggcgtggtggcgggcgcctgcggtcccagttactcgcgaggctgaggcaggagaatggcgtgaacctgggaggtggagcttgcagtaagccgagatcgtgccactgcactctagcctgggcgacacagcgagactccgtctcaaaaaaaaaaaaaaaaaaaaagctcctagagagaggtcaggtcaactcttcccaggaacacagagcacaaggcaaggccaggactggagcccacactgtctgactccagaccagctcgtgcccgccatgtatcctgccagtctggcatccgtgcagtcaattgtctctcttgcacctgtctctattttcaccttcaagcccaaatctgcatgttttatgctaggtttttttttgttctatctggttctttttcaaattatctatcactacagttttatgaaaggtgcctctgggggaactgagtgaagtgcacagggccctctctgtcctatttcttaccactgcaggagtggctacaattagctccaaaacacatgcgatctgacacttcctgggcttctgactgagttccatattattaatctgactaatcctgtgggttttttctcctttaatagttgctcaacaccactgaggttcgatcaccacaactgcaagagccacagaaggttccaggggcctgggagacagtgagttatgaacaatggcccccatcacagcaaatacacatcagcagagatcaggaaacagaacaaatgagtcctgagttattaaaaaagaaagaaaggccaggctgaagaaaacccttgagctgcactccagcctgggcgacagagtgacactctatctgaaaaacaaaacaaaacaaaaaacagtgaagacaaagacagatgagacgcaggaagcagttcgcaccaaggctgtgcccggaacgtcctctcttttctttccacattaattactctcaagtcacccgggcttccttgtcaagtttccccctactcttttgataaaacacattttgttaattacgtagtttaatagttgtgtacacatttccctaaagcgggcagacacagatgatggtggccaggctggaagtgggaggaacttcgaggcaagcctggggtgaaggcttggagaggcaaaaccacaaaagcaaagcagcaggggacctgtgtgcaggcaggagcaagttcccaaatcagagggcaaaggagaaaagggcccagaaggaaaagcctaagaaaaacattatttctcagaaataccaaatattttcaaactgctccgagaacactaacaattttgtactggtgtataaaaataattaggctgggcatggtgacacgcggctgtaatcccagctactcaggaggctgaggcaggagaatcgcttgaaccctggaggcagaggctgcagtgagccaagatctcgccactgcactccagcctgggcaacaagagcaaaactccatttcaaaaacagaaacaataaacataattaagaccgcattagctacaactagaaaggaaagccgcatcacagtagcagagcaccctgctaaccacacaggtactgagagcaggggacagaacatttaacatgaataactgccaactaggttactaagatggaaataccacatggaggtggcaaatgcaggaagcaccttctgccattaggatcaggaaattaaagaagaggctggaatttttatttgagacagagtctagctttgttgccaggctggagtgcagtaacaatctcagctcactgcaacctccgcctcctgggttcaagcgattctcctgcttcagcctcccgagtagccgggattacaggcacgtgccaccacacccagctaatttttgtattttttttttttttagtagagacagggtttcactatgttacccaggatggtctcgatctcctgacctcgtgatccgcccacctcgacctcccaaagtgctgggattacaggcgtgagccactgcgcccggccgaggctggaatttttaaaacttagaaacctggacaaagggccctgtaaaactgaaactcagacccctgaggatggggtgctgctggccggcactgggtctctgagctcaaaggcagccccacaggctgggtccccagtgactggaaggagtgcagccagctgacgctgggctctctgaggtgactgtggcagggctgttctgctggcgtggggaaaactccaaactggcaccagtggccgactgccagaaggaacttcgctgccaggatggtactgctagggtgtcactctaggagggagcgggcaggaagctgcaagtcgtcctcccgcctcccagccttgtagtctccctccagcacctgcttcaggcagagctcaacagggagtgggggggtcagagctccccaggattggctggggtgtggggtggagtgaggaggacatcagtgccggtgaagcaggtgaggggagggaaccaggtgaggggagggaaccaggtgaggggagggaaccaggtgaggggagggaaccaggtgaggggagggaaccaggtgagggagggtggtcctcttgttacctacaggaggactgatcagataagcaacattcaggatgatggggctgggttcctcactgtccaagtgaggagttatagataaggaagaaaacgagaataaaccgtacaacactgggatagaattgggttattggtatgaacttgcagcttcaatatagacagacagatacagggataaacacagccatatatgggtgtgaacatacagagtcctagctctgtctaccgaagagtatccggaagcagcagcagttcagctacaagcacacccagtgtggaccatggtctctaaagaccattctccaacataggacagggctcctcaggcagctccagagctgggtcaggaaaccgcaaggtgagcctgcagcagccggtgcccagaagtgagagtgtgctcaaaatgaacacaagcagtcacagatcataatctattcaataaaacagggctgggtgcggtggctcatgcctggaatcccagcactttgggaggctgaggcaagaggactgcttgagcccaggagttcaagaccagcctgggcaacatgacaagactctatctctacaaaaaataaaatcatgaaccagggtgtagcggcacacacctgtggttctagctcctctcaaggtggaggcgagagatcgctggagcccgggaggtggaggctgcagtgagctgtgtttgcaccactgcactccaggctggacaacagtgagaacttgtctcaaaacaaaaacaaaaaacaccaggaaatcaggagtccacactgatattaacatataaaatttaaaaatctgatgaaaaatgggatatttatatagtttcaaagtacatccaaacaaaatacctatcaattacgcagggaaaatggtgactttacagtgaagtcaggcagacatcacctgaaatcaagcaatcagagcggccagcatcagttacgtgatgagacgcaaccgcacatcccacaggacacgagggggaaaccatagcctcacttctgtgattttcctgcaaagatccacaacccaaatccaaccaccgggaaacaccaggcaaacctaaactgaagaacagtctccaaactgtcagcctgaaaccttcagcagtgtcgaggtcatgaaagtcaaggaaagacacagaactgatcacacagaaaggaacaaggtcatggtgtgtgtggctctgcagcaaacccttccttctgctacagagcagagtaccagaaaatccgcaatgcttcagtggaatctgaaggttagatacagcaatgtatcaatgctacattcctgattgtgttggttacaccgtggttatgtagaatatccctgtctgcaggaaatacatgctaaagcagtggtcccaacctttttggcaccaggggccactttcatggaagacaatttttccacagacccgtaggggggtggaggaggtgaggtgatggttttgggatgaaactgtcccaccctggatcatcaggcactggactctcataagcagcatgcaacatagatccctcaaatacacagttcacaatagggttcgtgctcctatgagaatctaatgccacgctgatctgaccggaggtagagctcaggtgggaatgctcactcatctcctgccgtggagtctggttcctaacagaccatggagctgtccgtggcctgggggttggggatccctgtggtaaagtattcaatggcaaacagctgggggaggagagttcttctgttatttgcaacttttctgaagtttcaaactatttcaaaaatgttttaaaaatacttttagaagttcatttgttgctatttggaaaacttagaggggcaaggagggagggcccactggatacagccaccaccgccccattaagataacaatggtggcttagaaatgaatgggacagtggtcctggaacagaggaggaagtcgcatcgatagtgttggaactagagtggattgtggcatgggatgagcaaagaagattccaggatgtgcactaggtttctagccacagcagcttgatgaatggggtgctacacaccaaagcaggagaggccaggagagcagcaggttggggtgaggaggggagtagggcctggggcaacggaatccaattacatcacgtagttagtgctacagtctgaaatcgtgaagagaccatctcaaaaaattgatttttcttacaggaccctactgctgttttatattttcaaaaagtgatcacttcgaaaccaccagcttccatggggatggggagaggtgaggcgtgagaagtgggagaaccagcctgttgtgaggcaactagagacagacacagcttccagggaggatgcaggccattcggttttttggtttgtttgtttttgagacagggttttgctctgtcgaccaggctggagtgcagtggagtgatcacagctcactgcagcctccacttcccaggctcaggggatcttcccaccttggcctccccagtagctgggaccacaggcatgctcccatgccagctaattcttttttagagacggggtcttgctgtattgtccaggctggtctagaactcctgggctcaagtgatcctcccgccttggcctcccaaagtgatggaattacaggggtgggctaccacacctggccatcctgaaatatgctaaggccctagagacacggccgccctgcagctcagaagctgggccaggctaaccagccagcactcacaaggctccaagttgcagcaactgggaggctactgtccaccacgccttgcattgcccacaccatcacccacagcgtcagccatggcacctgggcatcatctcagacttctcctgaagagcccgtagccctcacccagcacaaagccacctcttcctgcccgtcttcctcaccaggctctaaggcagggttgatcgctgctcccctggacctgccacgctgacaggactccttcagcacagctgcctgtgtctatggcatgtggcaactgacattcacgaggagtcatcaccaaagggcggccttctctacacagggggttcgcacccctcctaagataaggacattcaacatcttgggagattttccatccaaaaggctgaataaagctttagcctttagacagcttaacttttactggagaaattttctcctcatcaatctcttcattcctcctaccccgaactgtcccctaaagaacttctcttgatgctctagaaaacaatggattaatcaatcaagtgtaaccaccgacaaatatgagatctaaactgtaaggcaaaatggagcccagtgctccctttaaataggaaaagctttgccaagaagaactgcaggcggagggaggatctttgtctaaaactgacagaaaaccattgtgaaatcaaacaagatgagaccagctggaaggagtgcccagggtgggagggtctgaggaaagaggacggtgtcaagagctgaagcctgaggcaggcgggcaggaagtcctgctttcccctgtccggcagaagctctccgcctccccctggatggttctgttcatccgtgccaccctgactgtttgggcctcagctgctttgtggccacaatcaatacatttggaattggaaagagtctgacaggttatccattacgaataataccttttaccaatgaaggtgaacagggccccaatggccaagcaacatgcagaggacacaagggacagacgtctcgcccccgagtcgtcaactccacccacagcgtggttctctcctgaggtcctctccttgtaaccgccagctaccactccgtcccttcaagagatggcaggacccacacctgcctggagcagcacctccacagctgctggagcgcgggggcagctgcaggggaggcacctaccgacggcccagcaagacctacgcggaggccgagggccagaggccaggctagagaaggtatggatgtgtgcgagggcccaggcacactgacgcgctatgcatccggacctcctgcagagagagaaggggccagagcagcaccccagggaccaaggagtgcagccacagtggacggggcacatgctgaacccccgtgagagagagagcacagggcgtgtgccaggagtcagcgccttggcccgcacgtggcagggaatgcaggcgccttcacaggaccaccctggagagagttcacagctccaaaggcttggaatttattcttacggttcagacggctgacgcagctacggaagattagtacctatcacaaagttttagaaaaatgtgttcaaattacacaaaatgtgttttctttgtttcacaataactaagctcttttgtaagatgtcagaatactgcctttgcaaggagccagccacagacccctctcatcaggaatcacgagtctgagaaaagtgactcttcccacaagccctcttaaccccaaatacagttctctaaataggagctctagctgatataggagcacaggctgataaccaggaagtataacgctgtaaaaagaacaaccattaaattttaacttaatgcaacttgagactttagaggattaaaaagggagccctttaagaacacgtggatgtggccgcgtgcagtggctcacacctgtaatcccagcactttgggaggccgaggcgagtggatcacgaggtcaggagatcgagaccatcctggctaacacagtgaaaccccgtctctactaaaaatattttttaaaaaaattagccaggcgtggtggcgggcacctgtagtcccagctacttgggaggctgaggcaggagaatggcgtgaacctgggaggcggagcttgcagtgagctgagatcgcgccactgcactccagcctgggtgacagagtgagactgtctcaaaaaaaaaaagacatcaaggccatcctggccaacatggtgaaaccccatctctgctaaaaatacaaaaattagctgggcatggtggcgcgtgcctgcagtcccagctacttgggaggctgaggcagaatcgcttgaatccaggaggcagaggttgcagtgacccgagatcgtgccactgcactccagcctgggcaacaaagcaagacctagtctcaaaaaaaaaaaaaaaagaacattcagatgcaaaagacaggaagacaagtgagaccacagattgagtctgagaaaacctgaggagcggggtgggccagagcgggggtcgtgtggtacaggcggggatcatgtggtgcaggcgatagcagtctggtcagaagcagcggtgagatcctggctgttcctgaaagtgagacgagcggatttcctgctggatggggcgtgcaggttgacactcgcacagagcactggccaagcactaggacgctggagttgcctgcatgggaaggctgacagaggctggtgggctgagtggcagggaagcagctggacaggtgatgcagttccagagagaagcccaaggtgcccagtgtacagctggtatcggatgagatcaccaggaagtcagcagagagaggggaggggccaaggacagaaccctggggggcttcgacatgaggtggctgcggggaagagaagccagcagggtgcagagaaagccaggacttccatcctggaaggtggatgacaaccaggaattacctactggcttttgccacgtggagaccacaggtggccttgacaaaagcagcagttttgagggaggcaggggacagaagtctgattggccttttgagaatgagagaggtggggtggagacagaagagagaaccctgaagagttcttgttgctgttgtttttgagacagggtttcactctgtcggcagcctggagcacagtgatgccatcacggctcactgcagcctccacctcctgggctcaacggatcctcccagtctcccaagcagctgggactacaggcacatgccaccacgcccgggagatgtttgaaatcattttcaccaaagtgttttgtttaaaaaacaaaacaaacaaaaacaccactcatcttggcatagacggaaagctggcccattccccacgggtgctcacatcacactcgtcaactgatccagctgttagggggcagggtatcacccagagatcacagaggctggagacaagttcattctcactggcttaagtgttaacaataaaccataaattaaattctagggtgacaaaataaacgccccaagcttcaataagcaattgtgagaacacagccaattccttgaaacgaacattattggtgcttgctgcatctgtgcctccacccagtcagtagggggtgtttctctggaatgggctcacccacccccctcaggctcccactgcaccagtccacaccagttctcttaagaactgttcatttacacaccatgaaaaaagcagcaacccacagatatagctattttttttcttttcttttccttttctttttttttttgaggcagggtcccccaggctggagagcagcagtggcgtgatcacggctcactccctgcagccttatctcctgggctcaagtgattctcccctcagtctcccgagtagcagactacaggtgcgcattatcatgtggctaatttttttttttttttttgagatggagtctcactccatcacccaggctggagtgcactggcgcgatctcggctcactgcaacctctgcctctcgggttcaagcatttctcctgtctcagcctcccgagtagctgggattacaggtgcctgccaccatgcctggctactttttctatttttagtagagacgggtttcaccttcttggtcaggctggtctcaaactcctcacctcaggtgatccacctgccttggcctcccaaagtgctgggattacagggatgagccaccatgcctggcagtggctaattttttattttttgtagacacggggtcttgctatgttgcccagactggtttcaaactcctgggctacagtaatcttcccaccttggccttccaaagtgttggaattacaggcatgaaccactatacctgatcctaattgttttttctttggtagaaattaataattttactcactggtttttcttaattttttcctttttttaactgattttcgagtaaaaactttagttttgacaaagaaaatatattcataaacatatacacttttattaagtcaactactggtattatattaaatatatatcttctaatatgcagaatatatatattctaatatgcagattttgcagctcgccaaacagaggtatttaagatcacgcacagatcaattttcaaagacaaaaggcagcacacagtgcagggaaatctagtcccagagggagcccccatgtcagctgggcaggacccttcacaccagcagcactgatgggggcggtgcccaccccggccccaggaacaggatcacaggaaatgagctcagctgctgcactggagcaggatgagaaatcgagaatgaatcctcactccttcctagtacaacgccagagtagtcctaaatatatacagagacgctctcccacacactccaaactgggctgggaccgccaggacaggaaggacgacgtgacagccaggaagagaaccgtctacgcatcttcctcctggaaggcctcggacttgtctctgtttaactgaggcggaaggacagaaaggagccccaatgctctggcctctagagttctgtaacagagtccgtcctaacttactcttcctggctctctaacccttgagactgagacttgctaatacacttctagaagacagtgggcacagcactcataacaaagtacagtgattaaacggtatctacagtgattaaatgcttcctaccccgcattaagaagcagggaggaagagttttgaatgtaagaaagtaaaaagtttgcaaagcatcagtaaataaggttcaaaggagagcaacttaacttcagtaattagtaatttggggaatttttagcaactattcgtaacatccaccaaactcttaggattaattcaagcttataacatagtccttcctatttgacagacttgagaaggcaggatcttttaatactttcaatttgctttttattctcttataccctaaatatttgatgaaatattcaacccacccattgctaatggcagcttccactttctgaacatctacatatgggtcagggatgttatataataatatctctacaggcatatggtctcaaaactcctgggctcaagtgatctgcccacctcggccttccaaggtgctgggattacaggcgtgagccactgggtccagtctaaatgtttggtatttttaatcccttgttatttgtctttactccccacataagactttttacgtgtcagttttaaaattcagaggcaaaaattaactccactcatttttcttgttgctcttaacttaatctagtagacagtatattttgaaatttctttgtgtcactgctgtgaattcagaaaagtctggttttctttctgcacagtaaaataccagctgctcctaatgtcatgattagtaccatcttctgaagaattgacagtccatgcagcaagtatcattttagtttaaggtgaactgtgtctttcaaattacttgagaactggtaattcaagtaagcaattctttcactctcctgtaagcaagcacactgtccgatgtgccacccctctcccccaccaattgcacttggatcgcttaggctaacatatgtgtaccctacggcacagaaattccctcccaggtaaacacccaagagaagtgagcaggtatgtctaccaaaaagacacacacaagaatgttcaaagcagctttactcataattatcaaaaactgtaaactacccaaatgtccactcacagaagagtggataacctgtagtattcatgtaatgaactagtacacattaaaaaaaaaaaaagaaaaaaaaaaggaggagccaggtgtggtggctcatgcctgtaatcccagcactttgggaagccgaggcgggtggatcacctgaggtcagacgttcaagactagcctggccaacatggtgtaaccctgtctctactaaaaatacaaaaattagccaggcgtggtggcacatgcctatagtcccagctactagggaggctgaggcaggagaatcgcttgaacccaggaggcagaggttgtagcaagccactgcactccagcctgggtgacagagcgagactctgtctcaaaaaaaaaaaaaaaggatgaactcctgtcatacacaacactgatgaatcacacggatgtatgtgaagctaaaaaaaaaccagacacaaaatactgcaggattccattacatgagactcagaaacagacacaaccccaagatcatgcaatgggggaaaacagcatcttcaaatggtactggggtggctggacaaccacatgctgaagaataactgtgcgcccctacctcacaccatatacaaaaaaattaactcaaaatgaattgaaggcctacatgtaagaactcaaactacgaaacacttaaaacacggctgggcgtggtggctcacacctataatcccagcactttgggaggccgaggtgagtggatcatgaggtcaaaagatcaagaccatcctggccaacatggtgaaaccccgtctctactaacaaaaattagctgggcatggtggcacatgcctgtagtcccagctactcaggagactgaggcaggagaatcgcgtgaacctgggaggcagaggttgcagtgagccgagatcacgccattgcattccagcctggtgacagagtgaggttccgtctcaaaaacaaaacaaaacaaaacaaaaaaccacatgtaaatctttgtggccttggattaggcaatggattcttacaggtaaaacatgaaaaacaggtaagttaaacttcaccaaaataaaaatcattctgttttttaactacaaacaccaaacctgaacaaaaaaatgttcaaaagaagccattaagaaagatggctgggcatgggtggctcacacctgtaatcccagcactttgggaggctgaggtgggcagatcacaaggtcaagagatcgagaccatcctggctaacacagtgaaaccccgtctctactaaaaatattttttaaaaaattagccaggcatggtggcgggtgcctgtagtcccagctactcaggaggctgaggcaggagaatggcgtgaacccgggaggcggagcttgcagtgagctgagatcgcgccactgcactccagcctgggcgacagagtgagactccgtctcattaaaaaaaaaaaaaaagtgagaagacaaacaacagaagcgtaggaaatatctgaaatcacatatctgataagggacttacatccagaatacacaaaaagctctcccaactcactcataaagacaaatatcccaatttaaaaatgggcaaaggatctgaatcatcatttctccaaagaagatatattaatacaaatgcccaatatgcacagaaaaagatgctcaaagtcattcgcaatcagggaaatgcaaatcaaaactgtaaccagacctcacttcacacccactagggtagctacaataaaaaagacaaatcataacaagcgttggccatgaggtggagagatgaactcttacacactgctagtgagattgtaaaatgatgtagcctggcagttcctcaaagtgctaaacacagttactacatgacccgtcattccacccctaggtatataaacaggagaaatcaaagcatgtctgcaccaaaacttgcacactgcatgtttactaagaaccaggttttaaaaaatttaatataaaaaaaatttgtacatgaatattcacagcagcatcattcgtaatagtcaaaaagtgaaaaccgaaatgtccatcaactgatagctaaataaacagaatgtggtctacctagacaatggaatactactattcagccagagaaagtaattaaataacaatacaacatggatgaaccttgaaaagattatgctaaatgaaagaagccagctacaaaagaccacgtatagtatgattccatttatataaaatgtccagaataggcaaatccatagagacaaaaagtatattagtggttgccaggggctggggagagggaatgctaagtactgctaatgggtacaaggctcaggggcaatgaaaatgctctagaattagacagcggtgagagctgcacaaatgtgtgaatagagtaagaaccaataaatcatacacttaaatcaaaaagccaggcgtggtggatcacgcctgtaatcccagcactttgggaggccaaagcaggtggatcacttgaggtcaggagttccaggccagcctggccaacatagtgaaaccccatctctactaaaaatacaaaaattagccaggcgtggtggtgcgcacctgtagtcccagctgcttgggaggctgaggcaggagaattgcttgaacctgggaggcagaggttgtgatatgctgagattgtgccactgcactccagcctgggtgacagagcaagactccttctcaaaaataagtaaataaaacaataataaaaaaccaagcacaacgaatctgtgatatgggtcacaacagtgtgtaccacacatgagggggtcacaacagagactacttgggtgcacgattcattaatttattcaaaaagtattaaaggtatttaaaaatattcctgaaatgaagcaagacattgtggctacgagtaagcacctgagtccttcagacttcaccgcttactgtgttgcaaaatactgagcatgaactccagtttccttgtgggtaaattaaggataatcccagaactgtgggtgaatgtgacagtggatgtcaacaatgagcagtgccaggctctgagacagccccagcacgcagagccagcctaatcgttttgtgatcacatacgcatcacagaagatgtgctgggcttcccctttcccacagaaacagcatggaagcccctcccaggaacacgcccgtctgcagtgcagctcagtgcctggtgcacagctggcgctcaacaggtgcatgtgagtgaaaagaaacccacagcttccagaaggttcttcctacgtcacctgcctccttctatattctgtgcccatgaacttggacatccagaacatactctcctatctaaatacaagtacatgcaattctcccttaatagggctgttatttatttgtattttatcttttattatttttaaactcattcaactggaaaatactagtgacaagaaaaacaaattcatgccagggactttttttcatcctagcatagatcctgagatcagcagagttgatctgagttgctgaaaccttctgcatataaaccattttcagcagggttcttaacaactgtccagagccaagtactgaattatctgagtccaactgccaatctttctaaattgaatagtcaatatgtcaggaatactatggtgttaaaaaagaaaaaaaggataaaagtaaacatttttatgggaaattttctcttatccaaaattccttcaatcttttaccttatttagacattgactctgcatttctgcatgaggaataagtatgtctctggaagaaaaaatactgttgctaattatatgaaacttctaggacctaatccagcaccagagaagtgaggctaaagaaatgctaaattacgcttgtaatcccagcattttgggaggccgaggtgggtggatcacgaggtcaggagatcgaaaccatcctggctaacacggtgaaaccctgtctctactaaaaaatacaaaaaaattagctgggcgtggtggcaggcacctgtaatcccagctactgaggaggctgaggcaggagaatggcatgaacctgggagacggagcttgcagtgagccgagattgtgccactgcacttcagcctgggcaacagagcaagactctgtctcaaaggaaaaaaaaaaaaaagaaatgctagattggccaggcgtggtggctcatgcctgtaatcccagcactttgggaggctgacatgggcggatcacgaggtcaagagatcgagagcatcctggccaacatggtgaaaccccgtctctactaaaaatacaaaaaaaaattagctgtgtgtggtggtgtgcacctgtagtcccagctacttcggaggctgacgcaggagaattgcttgaacccaggaggcggaggttgcagtgagccgagatcgcgccactgcactccagcctagtgacagagggagactccatctccaaaaaaaaaaaaaaaaaaaaaaaaagaaatgctagattggagccctcagtggccagacacgcatgtgagcgggaagcaatattcaaaacagcaatagcaatccatccagcaactccagccctcccagcacctgaggggctctccagccagcaactccaaccctcccagtgcctaactggctctcacagggtggctgctcctgaaccagaggaagggccaccaagcaaaccgccctcagagtgaggcgctcactttccttcctgaacagaggagaagcgtggagcggccagcccggcctcaccttgcccgacaggagtgaccagtagtcgcccatctccatggggcgtgcccagcacggtatcaaagccctctcatggccaatgaggttgaaggtggaaatggtacctctttttaaaacatttaagaatgtttagaagaatctggttcttttaaaaaagaggcaaagaaagtttgaggagcatagtttggataacaatggcttcactcattttaaatgttatttatttcagcctcaacaattaaatgtgttcaggtggccaggcacagtggcttatgcctgtaatctcagcactttgggagaccaaggtgtgtggatcacccgaggtcaggagatcaagaccagcctggccaacatggtgaaaccccatctctgctaaaaatataaaaattagctgagtgtggtggtgcacgcctgtagtcccagctacttgggcggctgaggcgggaggatcacttcgacctgggaggtggaggttgcagtgagcccagatcccatcactgcactccagcctgggtgacagagggaggctccatctcaaaaaaaagtgttcagggctggctcacacctataatcccagcactgtgggagctgagacaggtagatcacttacgcctagatgttccagaccagcctaggcaacatggcgaaagcccgtctctacaaaaaaattcacaaaaattaggtcagtgtggtggcatgcacctacagtcccagctactcgagaggctgagacgggaggatggcttgagcccaggaggtgggaattgcagtgaggcaagactgagccattgcactccagcctgggtgacacggtggcaccctgtctctacacacacacaaaagtgttcagattggctgccagactacccacctccaatatgtcacatatccaactgaacctaagcatttctgagttactttttttttaattaaaaaaaatattttatgctgatatttttcagtattataaaaacgccggcatgaaggaaatgaaataaaaaaagtacatgacccagacaccaagcagagaaagatggccagtgtgctcctgtatcgtcatctttggctcaccatccccacgtaaacgcagtaataaacaggaaggaaggatgttttcacagaagacttgaaaatgttcttctgatttcatgaaagtaattggtaagccaggaaaactacccttttcaccagatgcctagagatgagacactaaaatcaacaaatgaaagagctttccaaataatcaataaaactttacggcaaagtcagcaaatgtttaacattttgcaaaaggacatctagctttgtgcagtctgcatttcctttcacaagctacaagagctgtcaaaaatgcttctccttaaacaaacgctgcagtaaaaatacaagatttatactaccagggtttatttgattatgaaaattgtacttttccagaacgtctggcgatttccaatttgggatgagcctggtatttctctacaggcgcccacacgcaggcctttccccagtgctctcagcaggaagggcctggggctcccaacagcaccaaggcccagcctctgtgcagcctgatgtgcaggtagaatgcccaacccgtctggcttctaagggctggattccggaaaccaactaaaaagctgatgtaccagagactacagcatcactcacatgggtggacaagtatcaactaatttttctgaacttcaattaaaaaatcaaaaagcttaagatcacattttaaaaagttgagtcctcactaattgtcaactccaaagtgtctccagtgaacaactactataagacctgccttctattattattattattatttttttttttttaagaaaaatgccacaagcccagggcatcctcacccagcaagcagcagagggagccaagagcaccagccggcggccagccttgtggcctcagggcagcggcaggtgtttctgatatgaaggcctggagaagcaacacgtatttcattcacttctccttgtccccctctgctgtctcagagtgacagatccaacctctcatgcccacccacgaggaccaaggagaagggaggtaataacgcacttctcggcctctctgcaaccccgcgtgggtgcacacttgggcctcaggcctcaccagctcctgactggaatatactttaccactgcaacatctgaaatgaaatcagaaatgcctatttttttttacatcgattgaacccccaaatagtttatttcccacaaaatatactgggccaatagtataggaatgatctgtcaaatgccaaatttgtccagctaggaaaacactagaaaccagttaaaacttttgaacaggacaggacaaatgccaattcttccacaaataaactgcaaaaaaaaaaaaaaaaaaaaaggagagagaaagagcttacagattaaaagagattaaggaggtgtacaatccaaatgcctataaaacaaatccacttttttttttttttttttttgagacggagtctcgctctgttactcagtctggagtgcagtggtgtgatctaggctcattgcgacctctgcctcccgggttcaagcaattctcctgccccagcctcctgagtagctgggattacaggcatgcagcaccacgcctggctaatttttatattttagtagtttcatcatgttacccaggctggtctcgaactcctgatgatccacctgcctcagcctcccaaagtgctaggattacaggcataatccaccgtgcccggccacaaatccactttttttaaaaaaaaaaaaaaaggaaatttaaacaatgactattttatgatattgagaaattactgttattttttaatgtcatattattatggctatgtttttaaagaaaaccctcatcttcttgagacacacactgaaatatttacaaatgagatgacagatttctgggattttcctaaaataatcctttttggggaaagggaataaaagtgaaatacaactgactgtgagttgataactgttgaaactggtggttcattattctatatgctctacctctttttgttttatttttgtttttttgtttgttttgagacggagtatcgctctgtcacccaggctggagtgcagtggcgccatctctgctcactgcaagccccgccttctgggttcacgccattctcctgcctcagcctcccaagtagctgggactacaggcgcccaccaccatgcccagctaatttttttgtatttttagtagagacggggtttcactgtgttagccaggatggtctctatctcctgacctcatgatccacccacctcggcctcccaaagtgctgggattacaggtgtaagccaccgcacccagctgctctacttctaaaggtatctgaaatttcctatttgaaattttaaactttgaaatttgaataggaaatattaccaattactatcacttttattaatactcattacacaaataccaccatataaaaaactcaagagactccaaaaaaggaagaatgacattttcatacatgagctcatcactattttcaataatatttaaatagaggatggctgagtgacatgggataccagctagaagtttctgaaaaattagtttccttttacaaatacccaaaacaggaagattgaatcgaaatcactacaagctcctgccccaaaccacacagcagtttcctcactggaagtgcattgcggcaggaaaatcagccccacgcctggtgtatttgccatgagtacgtttgttttattgctggcattccttctgggtcataaagcagttttatgagctgataaaacttctgtacggattctacaaagctgccatggcaaacagcttcagtattcagcgtaacatatctgtctccatctcctgcatctgattgatacaggccctttggactgactggactttcaaaaagtctaagatggcgactctcttactgttaaaatgtttatctaagtcttcctttccaatgtggtactggagaacgctttaggacaaacaagaaacatttaaaattctccataccaaactttatttttaaaaacatttaaggccaggcgtgatggctcatgcctattcccagcgttttgggaggccaaggtgagaggatcacttgaggccaggagtttgagacaaacctgggctcaactagtgagaccttatctcattttaaaaatacacatttaaaaaacagtaaaaatgaaaacatttaaagttcattttactgagaatatttctctcaaattataaatgcagtattttaagcatcattaaacttgcaatacaatcaacaacaggaattaccatagccgggaaaaaaataaactgttaagaaaagggaggtagaggctgggtgtggtggctcatgcctgcaatcccaacactttgggaggctgaggcaggtggctcacatcacctgaggttgggagttcgagaccaacctggccaacatggggaaaccccatctctactgaaaatacaaaattagccaggtgtgatgatacacatctataatcccagctacttgggaggctgaggcaaaagaatcccctgaacccgggaggcggaggttgcagtgagctaagatcgtgccactgcgctccagcctgggcgacagagtgagactccgtctccaaaaaaaaaaaaaaaagaaaagaaaagggatgtagaggggactatgaaatggatactaattcagaatagcctggatttttaaagtttctttccttaatattaaacaaagttttatttatattacaaaccaattattattaaaatgctattggagaaaaactataaaatctgatcaactgaggatctagcagtattcaaaaataccaccattcaataggggcaactagcaattaattctatactttttttttttttgagacggagtttcgcttttgttgcccaggctggagtgcaagtggcacaacctcagctcaccacaacttccgccacccaggttccagcaattctcctggcttagcctcccaagtagcagggattacaggcatgtgccaccatgcccggctaattttgtatttttagtagagacggggtttctccttgtcggtcaggctggtctcaaactcctaatctcaggtgatccgcctgcctcggcctcccaaaatgctgggattacaggtgtgagccaccgcgcccagctcaagtggttttataaatgcatactttaaaatttcactctctaaaatatttttcaggggtcaggtgtggtggtttacacctataattccagcactttgggaggcctgccaggcaggaggatcacttgagcccaggaattggagaccagcctgggcaacatagtaagacttcaactctacaaaatactaaaaacaaggccaggcagccaggtgcggtggctcatgccggtaatcccagcactttgggaggccaaggtgggtggatcacgaggtcaggagattgagaccatcctggctaacatggtgaaaccccatctcttctaaaaatacaaaaaactagctggatgtggtggcgggcgcctgtagtcccagctgctcaggaggctgaggcaggagaatggcatgaacccgggaggcggagcttgcagtgagcggagatcacgccactgcattccagcctgggtgacagagcaagactctgtctcaaaaaaaataaaaaataaaaaaaaataaggccgggcacagtggctcacacctgtaatacaccagcactttggaaggccaaggcaggaggatcgctttagctcaggagttcgaaaccaacctgggcaacatgacgaaacctcatctgtacaaaaatacaaaaattagccaagtgtggtggcacgcacctgtagtaccagctactggggatgctgaggtggaaggatcacctgagcccaggaggtcaaggctgcagtgagccatgatcatgccactgtacttctgtctcaaaaaataaaaataaaataaaatattctttttttttttttttttgagtgggagtctcgctctgtcgcccaggctggactgcagtggcgcgatctcagctcactgcaagctccccctcctgggttcacaccattctcctgtctcagcctcccgagtagctgggactacaggcacccgccaccacgcccggctaatttttttttgtatttttagtagagacggggtttcaccatgttagccaggatggtctcgatctcctgacctcgtgatccacctgcctcggcctcccaaagtgctgggattataggcgtgagccaccgcgcccagcctaaaatattcttaaacacaagactgaaagcttcttaatttttcctaaaactacagtaattctgacgccaaaatattccaaagataacatacaaaagttaaaaccacagactatctacagactactcctcatttggaaatacagatttaaaaaaataataaaaaaaatgaatacgataggctcaactgtgcagttagagaataaaatgccacagctaagcatgttttattctgggaatgcacatatgattctatagcatgtatatcaatacagacaataaaaaatagccaaactaaaatcacagttctgatacatgcaataaccatatttcaacattaatttctcattaaaagtcgtgactttttattttatttatttactgagataatgtctggctctgtcgcccaggctgcagtacagtggcacaatcatggttcactgcagcctcgacctcccaggctcaagcaattctcctgcctcagcctcctgagtagctaggacacaggcccacaccaccacgtccagctaatttttgtgtttttttttgtagagacagggtttcgctatgctgcccaggctggactcaggtatatctgcccacctcttataggcgtgagccaccacgtctggccatctcagacttttagacttatcaaaatcagcttttaatgtttaaaacaatctttcaaattaacattcaattttaatggaaaaagactagaacatgctttaaaataaaaaagcaagaaagacaattataataaactcgggggaaggagactttcacttttcgtggcatacctacttcttgtactgcttaaatttattttatcatgagcacgcttttctttttctttttgacagcgtctcactgtgtcacccaggctggagtacagtggcacaatcatagctgactgcagcttcgacctccccaggctcaagcaatcctcccatctcagcctcccgagcagccgggattacaggtgtgcaccaccatgcccagctaatttttgtataatttgtagaatcggggccttgctatgtcgctcaggcttattttcataattaaaaaaaattaaaataaaaatagtacttgccaaatgtaccttttgtgattggtattctgatactttcaatacatggtatgaggggcaatcccaaatcacagaaaaccgcagctcagcttacctacaactgccctccaaggacgggcccaaagctaagggctttgtaaagcccaaagctaagggaggtggctcaagagatatgtggagaggagtttttaaagaattttaggccgggcgtggtggctcacacctgtaatcccagcactttgggaggccgaggcaggtggatcacaaggtcaggagatcgagaccatcctggctaacacagtgaaacgcgtctctactaaaaatgcaaaaaattagctgggcgtggtggcgggcgcctatagtcccagctacttgggaggctgaggcaggagaatggtgtgaacccgggagacggagcttgcagtgagccgagatcatgccactgccctccagcctgggcaacagagcaagactccgtctcaaaaaaaaaaaagaattttaaaaactggctgggtgcggtggctcatgcctgtaatcccagcactttgggaggccgaggtgggtggatcacgaggtcgagagatcaagaccatcctggtcaacatggcgaaaccccgtctctactaaaaatacaaaaattagctgggcatggtggcacatgcctgtagtcccagctactcgggaggctgaggcaggagaatagcgtgaacctgggaggaggcggagcttgcagtgagccgagatcacaccactgcactccagcctggacaacagagcgagcgagactctgtctcaaaaaaaaaaaaaaaaccaaaacaacttcagcactccttaatagccccaaagcgggcaacccagatgtccatcaggagtggacaaagagagggttgtgaatacagtggacactacacaataaccacaaggaactaagctgcagctatacccaatcatgtggatggatctcagttactcttacttacaattactttttattttttgagacacagtatcactctgttcccaggctggagtgcagcagcatgagctcggcttactgcaaactccacctcctgggttcaagcaatcctcccacctcagcctcccgagtagctgagactacaggtgagcaccaccatgcccagctaatttttctattttttgtagagacggggggggggggcgggtctcattatgttgcccaagctggtctcgaactcctggactcaagtgattcgcccacctcagcctcccaaagtactgggattacaggctacaattaccttttattatggtaaaatatacgtaacataaaatgtacaattttaaccgttttttgagattgaccaagaaaaaaaacagcagcaactcaaattgctaggatggaaataaaagaagggacactactgacattaacagaagtaaagaagattattaagaaaaactatgaacaactgtatgccaacaaattagataatctaggtgaaatggacgaatttataaaaagacacaaactaccaaaattgactcttgaagaaagagaaaatgttaatagatctacaacaggcacaaagattgaactagtaatcaaaaaaataccaagaaagctatccaggcctggacagcttcacaggtgcatctaccaaacatttaaataagagttattaccaattcttcacactcttccagaaaaaggagaacacttcctaaatcattctataaggccagtattatcttgataccaaaccaaaaaaaaaaaaaaaaaaaagacatacaaggaaagaaaactagaatcaattacctttatgaatagatgccaaaatctttaacaaaatacaatactagcaaacgaaattcacaaacacagagaaagaattatataccatgatcaagtgggattcatcccaggaatgtgaggttggttcaacaaacaaaaaccaattaatgcaatacaccatatcaacagaagaaaacgagccacacaactatctcaatggatgcagaaaaatcacgacaaaatccaacaccctttcacatcaaaaacttaacaaactagaaatagaaggaaacttcctcaacctgaaaaggggcatttatgaaaacccgcagctaatgccacacttaatggtgaaggctacacgctttctccctaagatcagaagaaagacaagaatgtccctagtgctgtttctaccctacactgtactgaaggttctaggcagggcaagtagacaacaaaaagaaattaaaggtatccaagttgaaaaggaagaagcagaactatctgtactcacagagataattttatatataaaatttatatgattttttatgtaaaaattctaatgaattcactaaaaaaactactaaaactaattaaaaagttcagcaattttgcaggataaaagatcaatatataaaaatcaatttacctcaggaataaatttaagaaagtaagtgcaactcttacccctgcactgtgaatttaattaatgccactgaattgaacacgtaaaaatagataaagtggccaggcgcagtggctcacgcctgtaatcccaacactttgggaggccaaggtgggtggatcgcctgaggtcaagcgttcgagaccagcctggccaacatggtgaaaccctgtctgtactaaaaatacaaacattagccaggcgtcgtggcgggtgcctgcaatcccagctactcgggaggctgaggcaggagaatcgcttggacccgggaggcagaggttgcagtgagccaagattgtgccactgcactctagcctgggcgacagagcaagactccgtctcaaaaaaaaagttaaagcagcaaactttatgtatttttaccccaattaaaaagaaaactaaacaactctcactctgaaaactgaaactttttttcaattaaatttaaatttatttatttatttgagatggagtctcactctgaagcccaggctggggtgcagtggcgtgatctcgactcactgcaacctctgcctcccgggttcaggcgattctttcacctcagcctcccgagtaggtgggattacaggcggctgccaacacacccagctaatttttgtatttttgtagagacagggtttcaccatgttggccaggctggtcttgaactcctaacctcaggtgatccgcccacctcggcctcccaaagtgttgggattacaggcgtgagccaccatagccattctttatttgaattttaaaagttctaaataagtggaaaggcatcttatgatcgtgggacaagagactttaatactgttaagatggcaatactccccaaattgacctacagattcaatgaaatccttgtaagaatcccagctggcttactattagaaactgacaagctgttcctaaaatgcatatggaaactcaaagaacttagaaagaattgtcaaaacaatcttgaaaaacaacaaagttggaggactcatacttcctaatttgaaaacttactacaaagcaacagtaaccaagacagtgtggtactggcataagaagagacacatatattaatggaatacaaccgagagtccagaaagaaactcatacatttatggtcaactgattctgacaaggattctaagaccattcaacgggggaaagaatatagtctgttcgacaaacattgttggaactggttatctgcgtgcaaaagaatgaatgtaacccctctacctcgtatcatagcaaaaattaattcaaaattgatcaaagaactaaacgtaaatgctaaaactaaaaaactcttagaagaaaacacatgtataaaagaaaacacaggtatgaaactttgtgaccttgcactgccaatggattgttagatatgacagcaaaaaaaacaacaaaaaatatttaaatttgttttcctgcacagaaggggctctaggcagccatggcgcccagccagaatggcatggaagccccacttccacaaggactggcagctggctcgtggccacatggttcaaccagccggcccgaagatccgcagatgcaaggccgggcaagctaaagtgccccacattgccctgcacaccgcgttgggacccatccggcccatcgtgtggtgccgcacagtgcgaaatcacaccaaggtgcgcaccggccgcagctgcagcttggaggagctcagggtggctggcattcacaagaaggtggcccagaccattagcatctctgtggatccaaggaggcagtacgagtccaccgagtccctgcaggccaaggtgcggcggctgaaggagcaccactccaacctcaccctctaccccaggaagccctcggccaccaggaagggagacagttctgctgaagaactgaaactggccacccagctgacaggaccggtcatgcccatcccaaacgtctgtaagaaggagaaagcccaagtcatcaccgaggagaagaatttcaaagccttcgctagtctccacatggtccatgctgacgcccggctctttggcataccggcaaagagacaaggaagctgaagaacaggatgttgaagacaaaaaataaagccctcttgggacttgtaataaatcagcagtttaaaaaaaataagttaaattagacttcatcaaaattaagaacacctgtgcttcaaaggataccatcaagatagtgaaatgacaacccacaaaatgggagaaaatatgtgcaaatcgtatgtccaatatggggcttgtatctagaatatacagagaactcttaaaattcaacaaaaacacaacccaattttttttttttttgagacggagtctcactctgtcacccaggctggagttcagtggcgtgatctcagctcactgcaaggctccgcctcccgggttcacgccgttctcctgcctcagcctcccgagtagctgggactacaggcgcctgccaccatgcctggataattttttgtatttttagtagagatggggtttcaccatgttagccaggatggtctccatctcctgacctcgtgatctgcccgcctcggcctcccaaagtgctaggattacaggcgtgagccactatgcccggccaagacaacccgattttttaaatgagtaaagaacttgaatagacatttatccaaagaagatatacaaatgtctaattaacacatgaaaagatgttcaacaacatccgctattagggaaaagcaaatcaaaaccacaatgagaaacgacttcacacccactaggacagaaaacaacaagtgctggcaaggatgcggagaaactggaacccttgtgggctgctggtgggaatgtagaccactgtagaaaacaacctggcagttcctcaggatgctcaacacagagccttcacacgacccagcaattccactctgaggtatacactcgagggacatgaaaacatatcccacaaaaacttgtacattaatgttcagagaataggtattaaaaataaacaaaaggtactttgggaggcccaggcaggtggatcacctgaggtcaggggtttgagaccagcctggccaactaggcggccaaaagccacctctactaaaaatacaagaattagtcaggcgtaatcccagctatttgggaggctgaggcaggagaatcgcttgaacccaagagatggaggttgcaatgagccaagatcacgccactgcactccagcttgagagagagagcaagactccatctgaaaacaaacaaaaacaccaaataaataaacaaaaggtaaacagatgtccatcaactgatgaatggataaacaaaatgagagctgtccacacaacggagtactatttggccataaaaagggataatgcactatatacgctacaacatgggatgaaccttgacaacatgatgtcagtcatgaaagacccatattatatgacgccacttacagaaaatacccagaacaggcagatatataatgaaagtagatttgtggttgctcagggctggggtgggggtagagttggggataatagctaaaggttacagggttcctttggcggtgatggcgaagatggttgcatgactcgacgaatatactaaaacacaccaacactgaactgtatgctttaaacaggtaaatcatgcatgacttgaatctcgataaagctgttacaaaaaaaaaaaggaaaaaaattatctggtaattgtaaatggcagagaagcctttcttcttcactaaaataaactattagcagtataattcaacttaaatttctctatattgctgacagctggtttctgtttaaaactcctcctaacatattatgtcacaaggattatcaaaacttcataaacacaaatcttgctttttaaaaaaaataattaaatatttgtagaaggaaatatatccaggcttatcattttggttacataaaaccatgtcaatgtctgatgttttgagaaatatttcttgttatgacacagtataatatcaatgccatccctgacaccttaattaactggtaaaactggaaatagagcatttccagtaacttctcaattcgctgctagtcagacagtatttcccacatatttgaattcagtttcattttaaaggtacatcagaaagctgctctattaataaacaaagacttttcaacaatttggtttcaaatacttcgggttagaaaacaaatatccatttaagacagagctgcaaaattattattattactttttggagacagagtctcactctgtcgcccatgctggagtgcagtggtgcaatcatagctcactgcaggttcaaccaatcctcccaagtagctgaactacaggtgcacaccaacacagccggcacctttttttttttttttttttttgagacagagtctcgctctgtcacccaggctcgagtgcactggtgcaatctcagctcactgcaacctccacctcccgggttcaggcaattctcccgcctcagcctcctgagtagctgggactacaggcgcccgccaccatgcccggctaactttttgtgtttttagtagagatggggtttcaccaacttggccaggatggtctcgatctcctgacctcatgatccgccagcctcagtctcccaaagtgctgggattacgggcgtgagccaccacgcctggccctaatttttttaatttaattttgcagagacgggggtctcactatgttgctgaagctggtcttgaactcctgggctcaagcaatcttcccacctcggcctcccaaagtgctgggattgcaggcgtgagccaccgtgcccggcctccaaaattaacctttaaggattgctgcataaccactgataaaatcaacatctttctcaatagtaaagcatcagtagaaatggtatttcaaattgaagtataagatgggtcaggtgtggtggctcacacctgtaatcccagcactttgggaggccgaggcaagaggatcccttgagctctggagttcaagaccagcctggccaatatagggagactctgtctctaaaataaataaataaataaataaataaataaatattgaaaaataaattcggctcaccagttttttaaacaaagtgatagactgaattattttaattcaatgattttgcactaacaagggtgaagtacaacacagcaaggaccctgaagtgctgttttgggtgctgtggcaagggagttctagtcacctttgcacctcgctacgttatttatgtttttagagaatgatgaggggcaagaatatttcttattctgctctggtttattttcaatgggtgatttcctacataccaaaagctctggaggttaaacacagctctatgacatttccagaaagatgaagtttctataggcaactcctgcatcacaaaagcccagctgtgaacagccccacatcacgtggtctccacagggacccctgcaccctcccagccccgaggagcaggcgctgtccagccacccgaggagcaggcgctgtccagccaccgtatttccactttcaacacttccttcaggtactccctgcttcttcacattctcataacccccttctcctctcctccaatgcttgtacagccacgagagaaaaaagaaaaacctgctctcctgtcgtcccatttcctccttctattcatgggggactctttcaagtaagtaagtgtaagaatagaaacagcaacacatccaaatcaaaacaaagaggaactacactctgacttcgtgcagagttgagagctggggcgtctcgcacacctggaaaccacagcggcgcataatcacactgccacgagcctcaaggacaacgtgagctccaggagaacaggaattttgttttcttcactgctgcagtgcctagcacatcttaagtccttaaaaaatatttgctaagtgtacgacaagggatgacagcagactagaaatgtcaacacgattttgcagagtgggaaaaagcaaatggacgagtggtatctaactcagcaaagccagaaaaccagaacttaactgcgcagcaggggcaacgaggctggggaatgagaagaggcgctcagatctctgaaggcctgagggtaatgggcacaaaagagcatccgcttcaagtctgtgggagaagcagtcagatcctcccccaccagccctcctccacctcagccaccttcccagaaactgacagctatgccccccaacccctaaaccccaagcaggagactggaaactcctctctagggagacttacagccccaaaataaagaattctatcactaacttctggcagtggccctcaaattggcagggtccatgctctatttcctcatggtgagactcaacacttaaagtcggccctatgcatacagggagtttccaatcgtcccattcataaccatggaaagacagccagtaatcaccagagtttcggagagaagcctctaacaaagagaatgaccaaagtagaaaacaggtgaaaaagaacgcacaggaaacagacaaggtaggaggcaaagggaaagaaacatctacgtaacaaacgtgtgcaggaatcaataaaacattaaacaaagaaatgtgtctaaaacgcactgccttcatgaaacagaaagaggatgttacaaaaaggaatactgagaacaacaacacttttttttggagacagtctctctctgtcacccaggctggtgtgcagtggcgtgatctcggctcactgcaacctctgcctcctgggttcaagcgattctcctgcctcagccacaagagtagctgggattacaggcacctgccaccatgcccggctagtttttgtatttttagtacagacggggttttgccatgttggccaggctggtctccaactcctgagagttgatccacctgcctcggcctcccaaagtgctgggattacaggcaggagccgccgcgcccagccttacattgaatttttgtttctgacactgtatctttcatttttaagtgttcttggctgggcgcggcagctcatgcctataatcccaagcactctgggaggccaaggcgggtggatcacgaggtaaggagttcgagaacagcttggccaacatggtgaaatcccatctctactgaaaatacaaaaattagctgggcttggtggtggacgcctgtaatcccagctacttgggaggctgaggcaggagaatcacttgaacctgggaggcggaggttcctgtgagctcagatcacgccactgcactccagccagggcaacagagtaatactctcaaaaaaaaaaaaaaaaaaaattagaacaaacattaaaactacagtattatcaacaaaagttccccagagctgaaggacccaagcgtcccaatcaaaaagacccaccaaagaacattagagataaacaagagttccctgaaagcttccagagattttacaaaagaaaagtcccacacagagacttggaaaccatcgtggtctccgacttctcattaccaacactctcagtgtagacagcaatgcctccatgctttcaaacttctgaggaacaatgacttccaacctagaattctgtacgcaggcaaagtgccattcaaatgtgagggaagaaagggcattttcagccaggcatggtgactcatgcctgtaatcctgacacttggggaggccgaagcgggcagattccctgagctcaggagttcgagaccagtctgggcaacatggtgaaaccctgtctctactaaaatacaaaaaattagctgggtgtggtggtgtgcacctgcagtcccagctactcgggaggctgaggcaggagaactgcttgaaccgggaggtggaggttgcagtgagccaagattgcaccactgcactccagcctgggcaacagagcaagactctgtgtccaaaaaaaaaagcattttcagacagacctggttcaaaaaattcacctccgatgaattctttctcaggaagctactagaagattcactccaccaaaagatgaaagacacagaatccagaaaggggaattcaacagaggaaagagacacgaagaatccctgcaaggaatgaaaagcactccaaggaggactgctcagtagcaggcccgcaggacacccggcccaggctgaaacagaaaagtggcaggcctggaagggatgaaggtgataagattatgtgaggtgtttaatggaggagttctagttaaaagcctggcactaaattcatgactgtacattgaaaaccaagctaaagaaaattcggccgggagcggtggctcactcctgtaatcctagcacttcaggaggccaatgcgggcggactgcttgaggtcaggagttcaagatcagcctggccaacatggtgaaaccccatctgtactaaaaacacaaaaattagccaggcatggctgggcgcggtagctcacgcctataatcccagcactctgggaggatgaggcaggtggatcacgaggtcaggagatggagaccatcctggctaacacggtgaaaccctgtttctactaaaaatacaaaaaaaaaaaaaaaaaaaaaaaaaaaaattagccaggcatggtggcgggcgcctgtagtcccagctactcgagaggctcagacagaatggtgtgaacccaggaggcggagcctgcagtgagccgagatcgggccactgcactccagcctgggcgacagagcaagactccgtctcaaaaaaaaaaaaaaaaattagccaggtgtgatggtgggtgcctgtaatcccagctactcgggagactgaggcaggagaatcacttgaacccgggaggcggaggctgcagtgagccaagatcatgccactgcactccagcctgggcaacagaatgagcctccatctccaaaaaaaaaaaaatttactccatgggattattataagaaaagaaaataaagaaaattcactccaataacacaaaactatttcccttagtaaactgtatcttacatggcttagctgtgaagacagttacctaacaataagaatgcagacactgaattaccaatttaaacaaaattatataaacatatttggaacacagaaaaagagcaaggggtgaatgtgtttcaggcagtggagggacaatgtagaacagttctaaggcctcttctacagcagaagtcagcaatgtctaaaatggtaaaatcagaaattagcagtaccagcatgctacacagaaatatgaaatttaaggcaggcattgctaagcacccaccaatatccaaggatcttctatagtaacatcccacccccggcctgcttggctgaaggagggtgggatggccaccgtctcagatggtggcctgagggtgggaaaaggccacagccccggaggcctcttggagcaaggctgtccaactagcactgactgctgacacgtcaacttcacgtgagagaaatcaacctgattttatttaagtcactgtcactttgttctccattactggcagctaaatgtgatcctaactaaaatgataagtagaaacagagcagttaaaagtggtagtctgtgggaagttggagcgcggagcaagcgactggtagagggactgctgtcttgcactacaacccagtagtaccgcttagtttccaaaactaagtaaatgcattacattgataaaagttaaatgatgttaaaagaaaatcaccccatggggcatggtgggaagtgctgttaaccttaactttttttatttatttgagacaaaattttgctcttgttgcccacgctggagagcaatggcacaatctcggctcactgcaacctccgcctcccgggtttaagtgattctcctgcctcagcctcctgagtagctgggattacaggcgtgcgccaccagcccggctaatttttgtatttttagtagagacggggtttcaccatgttggccaggctggtcttgaactactgaccttgtgatccacccgtctcggcctcccaaagtgctgggattacaggcatgagccaacacacccggccataaccttaacttctaaagctaagattagatgcgtcttttggggtcaatttcaaattctaatactgaattgtggatatcagactttttattttaaaggcaacagaatatgaaggcattgtagttttggaaaggcagagtgatgaagagagtttgagactgatctggcagaggtatttaaaacttcaagtgggaaaggcattcatttaggcctgaggacctgagagctttacctaggtccctgacaatgagaatagaaagaaaaggctaaaataaaataaagatatttcaaagcaggcacctgcaaggaggcctgaggctgaccgcagtcctgtgaaggacagaaatgctggttagagggctgtttgcccagaaacggttagggaaaatgctcagaacctggtttacccaacctgagtggggagtgggctggagggcaggttaacatgacctccccaaattcctaacatagcggagcgcagtggctcacacttataatcccaacatttgggaggccaaggtaggaggattacttgagcctgagttcaattccaccctgggcaacacagcaagacctcgtttccacaaaaaataaaaaattagccaggtgtagcggtgtatgcctattgtcccagctattcaggaggctgaggctggaggactgcctgagcctgggaagtcaaggctgcagtgagacatgacagagccactacactccagcctgggtaacagagcaagaccctgtcttggggggaaaaaaaaaaattcttaacagttttccaacctatgactctgcaattttggaggtcagggaaatcatcacctaaattaacactgggaatcaccttacaataggtcccaaatgttctccaaagactctccaatccaaggaccgaatttgaatgaaattatatcattccattcaaatttatgtttgaatttctaattcctaagaaaaacaaaaatccaaagaagttctctattacacatcgattttttgcagttttaatcaaaaaacaattttgttgccactgttacctaccaatcaataaaactaaccaaaaacctaacccccaacacagattgtttaaaatcaaactgaaacttgacctttatctcccagttagtggctagtgtatttggggcgggggggcgggagattactacacgcagttcacattgccaaaacacttctgattttagatttaaggagagggtgtttcctctcatccattctcattagcaagagaggctttctgtgagcttctcacacaaatttaaggtaaccataacataccgtcatcccataacactaagaatctaagaaaaaaacaaacgtggtcaaggactaataggtattatgttatgggttttgggatgagattacatggtaacattgtttttagtctcttccagctaaaaaaaaaaaaaaaaaagctttgtctcttttcagagaaaagcatttgacagtttcactgtatttaatatagtttggaattaacagtcctgtgtgcctgcctgtttatccagtatcactaatgtcagcgcaaccaggagacatctaagggcacctggcttgcgacaagaggcagggcggaggcaagcagaggagctctctgtcaaccctgcagtgttgtgagttctgtaatttacatgcatttgagtattttgcctgaagggcaattcactgcacattttaaactttttcaggtagctcacacagtggtatcctgaagtgagaactatttcttcaaatccaattttatttctttgaagtctagatttaagagagacactgctgctcactgtgaagcccaactgtcatggaaggaagaggttttttgttttttttttggagacagggtcttgctctgttgcccaggctggtgtgcagtggcgcaatctcagctcaccgcaacctctgcctcctgggttcatgagatcctcctgcctcagcctcccaagtaggtgggactatgcgtgccaccacacccggctaatttttgtatttttagtacagacgggttttcaccttgttggccaggctggtctcaaactcctgatccactcaccttggcctcccaaagtgctgggattacaggtgtgagccaccacacccggcctgaagttttaagacagaaaaggtagggctgggttgttaatgtttaatggtttcagctgtcctatctcatgctattatagtcagtatcaaacagctaccatagaatctacatgatctaaattaggttaaactaatttttatcatgcaatcctaacatttccctataattcagatcttactcaaaagatctatttcttaagtctgttatttttaaaaagtgttcccatgttatgcaaatattctatccagagaaatcattaagataaaaatgtatttgagccgggcacagtggctcacgcctgtaatcccagcactttttattatgagatgtttagcaccgtgtcagttaagccttacttattaaattcggtggcatcatcccactcacaccttgggctggccattcccacactaacagctatgggcattcacatccatggaggaggaccgtgagaagatactatcacactcatggtgagaaaagccacaaatgaggaaccacccagaagactaggaggattaattctattcatgaagaggaagcacatctcgagagaagatgcccggactggggactggaaacccacggtccgcctctgtgacaccagcatcaagcctgaggcctccctcctggtctgacggccacacagcagccagggcagaggaccactgtggcctgtccaatgcccataggctaggatttcaaacatcagctccatccaaacgcaacattagctgttacaaataagctgtgggaaaaatatttaacacataagacagtatttgtatatgacaaagatgaaagacaacaaattcatctcactgggttgtccgtatttgttgctatttacttttggaaactgtaaagtgtttcatatgttctgcttcaaatggtatcaagatattttcaaaatagcttaaagaaatatacatgcaaggccaggcgtggtggctcacgcctgtaatcccagcactttgagaggccgaggagggtggatcacgaggtcaggactttaagaccagcctggccaagatggtgaaaccccgtctttactaaaaatacaaaaattagccaggcgtggtggcaggcacctataatcccagctactcgggagactgaggcagagaattgcttgaacccgggaggcggaggttgcagtgagccaagatcgcaccactgcacttcagcctgggcaacagagtgagactccgtctcaaaaaaaaaagaaaagaaaagaaaagaatacacacgcaaagctgggcattaaggttcaagatttcatagaggaaaccaatcaagctataggaaaattaaagacaaaaacctacaatgaaagttgaaatgactcggccaggcacggtggctcacacctgtaatccaagaactttgggaggccaaggggggcagatcacgaggtctggagatcgagaccatcctggctaacacggtgaaaccccgtctctactaaaaatacaaaaaaattagccaggcgtgatggcgggcgcctgtagtcccagctactcaggaggctgaggcaggagaacaacgtgaacccgggaggcagagcttgcagtgagccgagatcccgccactgcactccagcctgggcgacagagtgagactccgtctcaaaaaaaaaaaaaaaagttgaaatgactcttgtcccatgcgaccactgtggcaataagaaaatatgagccaaaaataatcatattttatttatttttgagacagggtctcactctgttgcccaggctggagtgtagtggcatgatcattgctcattgcagccttgacctcccaggctcaagtgatccacccacctcagcctccagagtaactgggactacaggtgtgcgccaccatgcccagctaatttttatatttttataaaattttattttgacatttattatagatactgggttttgtcaggttgctcaggctggtcttgtcttcctgagttcaaccaatcctccaccttggcctcccaaagtgctgggattacaggcatgagccactgcaccaggccataatcttcctttaaaacttaaaaagtttactacctatactttccaaatttcctcacatattccccattaagcctccaaatctgggctgaatcagctacttttcttccttaagtttcaagaattctccataattgtcattagatacctggcaagatttgggaagtggggaaaggttggcttttccacgtgacaggaatcgacatatcagaggtttcaaatgtcatggagtggtgaatccaaaaactgaacagtccactgatggacagcctatatgtgtttcctgagcagaagtaattccacttggaagttagagtacctaatattgctctataaatagttttattcaaaaacattattctgtgctttccaatcgaaacaaccaggcaattccaagcaacattaaatactaactgcacacatgttaactagaaatacaccactttagagttacaatgacgtatatgttaacataaatgagtttaaatacttgtaaaatatattgatatttcattaaaacaccaccttctaagtccattcttccctataattgaaagtttatacttttgtgcaaactgagttcctgagaataatgtagtttgtaatcacaatttccaaagagccagaatacaactttgaaaatatgtctatgttacagcacagttcccgtttagatttggaaaggccagatctcataaaatatgacctccacacatgctgacaagagcttcctccagggaagcccaccagtaatgcctggtggagagaggtggctgcacaatggcccccagggcccccgccctcagactaatcttctaggtcccaggccagaggccagtgggaccacatcttcccagcaaaaccaactttccctctgcttcctcttcccagtcacactcacaggtggtgcaccaagttgaacctgacagtggaactgtgtgggtttcaagatcgagtgatcagaaaggaacggtaaacaagctgggtgcagtggctcacgcctgtaatcccagcactttgggaggccgaggcaggtggatcacccgaggtcaggagtacaagaccagcctggccaacactgtgaaaccccttctccactaaaaatacaaaaatgagccgggcatgctggtgcgtgcctgtagtcccagctactcgggaggctgaggcaggagaattacttgaacccaggagatggaggttgtagtgagccaagatcatgccactgcactccagcctaggcaacacagtgagactcgtctccaaagaaaagaaagaaaaggtaaacaaaatattcagattttaacatgcaccaaagacctcactttcaaagcaacggtgaagtcaattaattattcagttggaaatcgtgtcactgacaaaggacgctagaaagcaaatactcttaatttactgatactataagtaaccaagaatggtggttcccacggaaataaagcatcacaggctgtccttgatctcaggacctctttctactgctgctctcacaagataccgtgtaacatttcactacagagtaatccaacagaagccctctaaagaatattgcaacttaagttttatttgtaaacaaaattccaaattccagtcaccaatctggcagagtagagtaggaggcctggaggcctcactgtggaacactttcatttgtttcttcgtataaatatcagctttatcagccccaaagattagaaattactggttcgaactgaacagtcctagcccagtgacgcaaatgacccaaggataaggttttcataggtttggcctgaacatacgcatttcctcctcctactcagtggttttaggtgagacagtctgagggtcttgaccggcacacccgttagggagagatgaagtaaaagagtttcacgctgcacttttacctgtctttaggatcctaattatcgttaaatggtttaatcaaatttttgtcctaaaaaagcataataggttagctgaccaatgattaaaacattatagatccggaacgaactagagaaggcatgcaaaattcagatgagaaagtttctaagtgatagctccagctacccctccaaatatcacaaaggtctagcagaattggaattaaaaaaaaaaagtcctcttgcacggtttatttaaaataaagccttaaccttaaaattcccttgaaggtgttacagcaaagtaggtattcaggctctgaccaacaaggggatgtagacaggctgtcacccaggaggggccgttagagctgggctccctggggatgcaagggggtcccacggggcagtgggcgaggcagatgcagaaagcacacccagctgcccccacaacgcagagaagcgtggggtggggaaagggaactaattccacactgcctccggaccccaaaggcgaggtgcgggggcgggggcgggggcgggggcggatatcccagtgagtgctgcaggaaatgatatccagactcggagggtggatctaggaagccgccagggcgagggcccggcgggggggagggggtgggagtgggaacgtaggatgtggctccaaggggcaggatgagggggcgggacgatcgaacgcggatgtcgagcctagggagggcaaggagggatgaaaagctagcggagggacgagggtgcaaggagcggctggagagagatgggctgcgggcctgggggcgctgccagagcgagaggaggcgaagcccacgagctgggtgggcaggagggcggcagggtctgtccgggcggggatgggcgggcgtggggatgcgcgggctggggcgcgggggtcgcagagccgcaggtccggccctgccggcgcgcacttaccccactcgaggaactcggccacgtacttgtcgcggcgcagggccgagtggctgcactcggtgtacaggcagacgagcacgtcgagcagcgtttccacgctcagggcgctctcgttgcgccagggcccgtccaggagcagctgctccagcttcttgagccgcaccttggccgacatggtgccgcgcggcccgctcccgacgcgccggcctctcaccgccggctcggccagtccgtcagggcgcgccctcgggggctcggcggctgcgagccccggcagcagcggcgcctcctcgccgccccgtccgcgtcgtcgcgccccggcctaggccgacatcttgggctccgtcccgacggcgcagagtctggggcgccgggccccgcgggtccatgggccgctctcctcccctcggcgccgccgccctcccagctcgggcggcccgcccccgccgccctcagccccgcccgcggccgcgccctccccgccgccgccgccgcagactaggagcggcgaggagcctagcgctgcgcaagcccggccggcgcccgagcccgaccccagccccgacccggcggcccagccccgcggcccgcagccaaccagggcgcggccagcaccagcgcagccaaccactacggggccggccgccgccgcgctgacctcagcgcgccgccccgccccgcgcccggctccctgctcccggcgggctcgggcctcgccgcttgccgtagggagccgggatgctgggaaggcagggccgggcctggggagcggcgcggggtgggggtggggggggcggggcggggcgagtgggccgctgagattgcggagcccgcgcatgcgcagagcgcgcctggtgggcgtgtgcgccttcgccctgcggacccggtgccttcagtattcggggtccgaccgcgcgcgtcgcggatcccggggccgaagacgaccccaagtatcggagaggcagagtcgcgatctcaggccgtcgagccccgtcccgcagtccgcgggcccatgttgcctgcggggcctcggacctgcccggccgaggtgggggtcgagggcggcccggcaggcgcagctctgatggcctcggcgggttgtgggctatttaaaacggcttgtcccagctcgaagcggtcctggaagactcgggccctacccctgactttaccgatgagagactgaggcccagacggtgtggggtcagggcccaggcttctgggggatgctgccaaggcgggagccagcgtccccagtgcccggtggattcgtgatggcttgcagagggtttcagtttccactgtccagccctccctgcagaccaatgcctaggtgtgacagtttggtaggaaaggggccggatatttgtctccaggctgggtttgcctagcgagtcgctgcatttactaagattgttggttaatttgggtggctgggggagggaggctgatggagataccccccaaccccaacaaacccttggcgtcaggagaggaggggcttttcctggagcttgcggaaggtcaccgaaatcgtgggggtatctgagagcttctggggcgcgcgggtgcaggggaaggggtcatgcttccgtggaagcggtggcctccaggtggagccgatgaaggggcagataggggtttgaagcaggacgttaagggagcctgaagcaaaactaatctctggagctaaaaataggagtgggcctggcgcggtggctcacacctgtaatcccagcactttaggaggccgaggtgggcggattgcctgagctcaggacttcgagaccagcctgggcaacacggtgaaaccccgtctctactaaaatacaaaaaactagccgggcgtggtggcgcgcgcctgtagtcccagctactcgagaggctaaggcaggagaattacttgaacccgggaggcgaaagtgcagtgagccaagatcgctccactgcactccagcatgggcaacagagcacgactccgtcttaataatagtaataataataagaagaagaagaagaagaagaggagtggctgcctatgccggagttgttgactggaacaagaggaggaaccttctgggctgctggtaatgttctatgcctggatttgggtagtagttacatgggagcacgcataagtaaacattcttcaaactgtcttcttaagatgagtgcatgtcactgtgtgtatgtatatataataccttcatttcttaaaggcaggtgagaacaatctggcgttagaggtgagagtactggttgcctttggggtatcaactggaaggaggcacaaggagaggcctctagggggctgggaacattctgtatcttcagcacagccgttttgtaacgttgggtctgtaaatgtgtataaattcatcaaactgtattctaaatatttgcatgttactatttgtgtatgacaccttaaaagttttttttaaaaagtctgagcagatcacctggctcaaaatcaaagttaaatcttcccccttggaccccttagggcctgagatgagcaaggggaaagggggctgtgcctggtgccatctccttccccaaacctccctcggctcgctcagcccacttccacccatctagaaccaccaccgggaagggagaaagggagaagtggggaagggctccaatcccatctggattggcagagggtaaagctgaccctgtctctcctgggaacattcatgggctcctcggtggttccctgctgctttgtctcctgaagtccccttaactcaagcagatgtgccactgggtggatgcttacctggtggctgtggaggggaggggccctctgcccttcctgagggacttttggacaggacctaaatggatccatgggtcttgtgcttgctcatccacccagctcacatctgtcctcaggaaacactggcacactcctcgccccaacattagtgaacaggtgggtcccagcacagcagcatagctctgcctctgaaacagcacatgagcccttcctgccactgtgccctccaaattgagtgccaaatattgagctctctgagaaatcccttggaagccaccctcacaggcttaaagtgaaggaaggagtgcctgtcctctgtgtcccctggcaggatcacctgaccaaactttctcttccactctcatcttttattcctgagtgtgggacagattcccaaacatttctcttgacaatctgcccatggcgatctgacatagcatttgagaattccacatctgctctctcttcttgcctcctggaaatttccatttactgttcttatacatttacaaatgtacaacaaaggtcatcgtgcctttggtggacagtccttgtattcgtctgccctcgctttctctctctcctgagccccatgccctgtgagtctgtgctccagctccactctgatcataggattctagaggggctggcaccagggtggacatgtgacccaagaccctagcagcacttcatcccccttcagtcatgtgactgaagccaggccaatcagagaacttatttgtttatgtattcatttatctatttattttttagagacatggtcttgctccgtcatacaggctgaagtgacttggcacaatcatagctcactgcagccttgaactgccaggctcaagtaatcctcccatctcagcctccacagtagtggggactacaggtgtatgccaccacatctggctaatttaaaaaaatttttttagagaaggagtcttgctatgtcgccccggttggtcttgaactcctggtctcaaacaatcttgctccctcagcagataacttatttagaatgttttatactggctgggtgtggtggctcacacatgtaatcccagcattttgggaggccaaggcgggcagatcatttgaggtcaggagttcgagaccagcctgaccaaaatggtgaaaccttgtctctactaaaaataccaaaaataaaaataaaaaattagctgggtgtggttgtgcacacctgtaatctcagctactttagagaatgaggcaggaaaactacttgaacccaggaggcagaggttgcagtgagtcaagatggcgccactgcactccagcctgggtgacagagcgagactccatctcaaaaagaaaaagaaaaagaaaaagaaggccgggcgcagtggctcacgcctgtaatcccagcattttgggagaccgagctgggtggatcacttgaggtcaggagtttaagaccagcctggccaacatggtgaaaccccgtctctactaaaaatataaaaattagcggggcatggtggcgcatgcctgtaatcccagctacttgggaggctgaggcaggataatcacttgaacccggaaagcggagggtgcagtgagcagagattgcaccagtgcactccagcctggacaacagaacaagactccatctcaaagatagtaataatgataaataaaataaaaaataaaaagaatgtttcatactaaaactgggagagagaatttcttgtcctttcctttagaccaggggcgggtaaactttttctgtaaaaggccagagagtaaatgtttcaggttttatgaaccctacagtctctgcatctaccattatagcaagaaagcagccatagacaatgtagaaacaaatgagcatgactgtgtgccggtaaaactttatttacaaaacaagcagcaggctaaatttggcctgcagacccgtagcttgctgctccttgctttacaacacaagctatgatggtgagacttcagctcaacagccacaacacctgttagagaaagaaagagaaaaatgagagagagatctggttacatgaaacaataaattttccttttctcttggccaggtgtagtggctcatgcctgttaatctcagcattttgggaggccaaggcgggcagattgcttgagctcaggagttcaagaccagcccaggcaacgtggcaaaaccccgtctctacaaaaaatgcaaaaattggccaggtgtggtggcgtgtgcctatggtcccagctacttgggaggctgaggtggaagcatcacttgagcccaggaggcagaggttgtagtgagccaagatcacaccactgcattccagcctgggtgacagagcaagcaagactctgcctcaaaaagaaaaagcaaattaatttctgcttctagcctagatggtgtgatcaggaccagatttactctcttacctgaaacaatgaaaataaaagagaaagaaaatggacaaaacacttaaaacaaggattttcatgacactagaaatcaggcatcaaaggacagtaatcagccaggtgtggtggtatgcacctgtagctccagctactctggaagctgagatgggaggatggcttcagtccaggggttcaaggctgcagtgagtcatgcttgcactactgcactccagcctgggcgacagagcaagactctgtctcaaaaaatgcataattttgaaaaaggacagtgatccctatccccgagacacaggaaagaggtggctctgtgactgccctgccaggaagggtaaagaggtggctctatgactgccctgccagggaggataaagaggtggctctatgactgccctgccagggagggtaaagaggtggctctatgactgccctgccagggagggtaaagaggtggctctatgactgccctgccagggagggtaaagaggtggctctatgactgccctgccagggagggtaaagaggtggctctatgactgccctgccagggagggtaaagaggtggctctatgactgccctgccagggagggtaaagaggtggctctatgactgccctgccagggagggtaaagaggtggctctatgactgccctgccagggaggggcaactgaggtggagctcagtggactccctgaggcgaggagacagagcagaaactgaagagaccaaggcagctagacctctcaggacagagtaccataaatgagtgagctgcacagagaaagccctggagatgggtagagagtctcctcaggcatccagcagcacactggccagtgctcacgcggatggaagctaccgcaggctggattaggggaaatagtgccaaaaaagattggaggaaatggtgcctgatgctcacacagactgagagtagtgttgttttccactggccagactggaaaaactaataattcacaggcattgggtagaattctcaagaaagttgtaccttggtaataggattctaccactaggaagtcatgcacttgcctttcccccagcatcccagaaaaagctctagactgagcactgctccggctctgcctaacgaattacaaatatgagacacaaaagtattaaacagtttccaagtaatttcatcccagaacaaagctcaagaaaatgtataggaatacaaaatatttagcacccaaaaaggtaaaatcacaatgtctggtatccagtcagagattaccagacattcaaaacacaacctatgatgaggatgccgtcaattaatcaaaaccaacccagaacttacacagatgttagcattatcagaaaaagatattaaatgttattataactgtatttcatgtgtttgaaaaagctaatagaattatgaaaatcattttttaaaactgtaatagaatttctaaagataagaaaactatttctgggatttaagatatactgtatgggattcatggcagattagacattacttaacaaaaggttagtgaatttgaagaaatagcaatagaacttatccagaataagacagtgagagaaaacaaaaacaaaaacatgaacagagcatcagtgaactgtgggactatttcaagtggcctgatacatggataattgggatcctgaaggagaagagcaagaaagaggaggaacagaaaaaatatttgaagaaattactgaaaaatttccaaacacaatgaaaattacaatctcacaaattcaagaagttcagttaatcctgagaacaggaaatatgaaaaacaacaacaacaacaacaaagcaccgaagcacatcatcatcaaattgctcaaaaccagtgataaagaaacaaaataggccaggcatggtggctcatgcctgtaatcccagcactttgggaggccaaggcaggcggatcacctgaggtcgggagttcgagaccagcttgaccatcatggagaaaccctgtctctataaaaaatacaaaattagccaggcgtggtaggcacatacctgcaatcccagctactctggaggctgacacaggagaatcacttgaacccgggatgtggaggttgcggtgagccaagattgcaccattacagtccagcctgggcaacaagagcaaaactccatctcaaaaaaaaagaaacaaaacaaaacaaaacaaaaaaccaaacacatccagagaaataagacacattacatacagggaaacagaggtaagagtgacaccaaatttcttattgggaaccactaagtgagaagacattgaaccacatctttatttatttatttattattttatttatttatttttttgagatggagtctcactctgtcgcaaaacacacacgtacacacacacacacacacacacacacacacctagcagcattccattgtaagatgagagtaggcccaaacatttctgggaggaacaagtaaacttcctgagtaggtgccttagactctaatagtatttgctcctactgttttgcaacatttcttttctttttcttttctttttttttttttttgagacactgtctcactctgtcatccaggctgtagtgcaaagacacaatctcggctcactgagacctccgcctcctaggttcaaggattctcctgcctcagcctcccaagtactgggattacaggcgtgtgccaccacacctggctaatttttgtatttttagtagagatgggatttcaccatgttggccagggtggtctcgagtcaacctcaggtgatgcgcccacctcggcctcccaagcatgaaccactgtgcccagacattttgcaacatttctttttctttttcttttcttttcttttttttcttttgagatagagtcttgctctatcgcccaggctggagtgcagtggcgtgctcttggctcattacaacctctgcctcccagtttcaagcaattctcacttctcagcctctcgagcagctggaattacaggcatgcaccgccacgcccagctaacttttgtatttttagtagagacagggtttcaccatgttggtcaggttggtctcgaactcctggcatcaagtgatccgcccaccttagcctcccaaaatgctgggattgcaggtgtgaatcattgcgcccggccctgcgacatttcttaacctgcaactacaccctaatggaaaatactttgttgtgatcagtcaacagaaaatgaaaaagtgggtctggcccacaaatttttctgcctggagtgctagctcccgtcagaggtagacaactagtgctttacagacaaaggagaggcccagaaagccagcattgaagaaaaatccttgcagaaggcaaaacttgtacattgattcacaggctatagctaatgggttggctggacaattagacacttgaataaaattctccaggtggcctaggggacaggcaaggggatggacttctcagaatgggcacagagtacccatgggaatgaatgcttattcattcatgggcacttactggggaggaggctctcagtacccaggtggacaagacagcctcttctgaggacatccattggcctcctccctccccttcccaatgctgctcaaacagcccgtgggcagctgactgaggcagcagagatgaaggctatgtagggactcagaagcatgacctttcctcacgaggctgatttggtatccatttggctgagtgatttggtatccatatggctgagtgcccaaccctcacagcagggacccaccctaagctcctaatgtggtgccattcccacaaggtgcagttgcccggtggccagcttgatgacattggaccccttctgtcatggaaagggcagtgatttatcctcacgtgttttatgtaaggacttgtttttccagccacatcacttctctcagcactaccatttgtggactcggacaacgctttatttatccctcatcatggcaacacaaacaccatcactttggactgagggactcatttcgtgttgaaggaagtgtggcggagagctcatggccatgaaattccctgaatttaccatgctccccattacccagaagcagctggtttgggagaatggaggaatcatctgcagaagactccgttaaggtgccggatgagagccaatagcctatgaggttaagctgccatcctacagggtgtggtgcatgcctcaacccagcaaatggtatgcggtgccatcccccgacacctcaaatgcatgggtccaggaactgagcagtggaggcaggaggggcccttcccattattacaccaaataacatactggaggaattttgccttccttcctgtgtgtgaccttgggccagtgtccaggaaaatgtttccatcaggaaacacagtcatggtttcgatggattacggtggaactgcccctcccccaactggcaatttccggttccttgtgccgctgaaccaacaggcagagaagggatcactgtgctggctgggatgacaatccccatcctcagagggagtttgcattgaattgattctcacaccgagggaaggcacgacttaaccacagtcatgcaccacgtaatgatgttttggtcagagactaccgcatccatgacagtagtcccataagattataatattttacgtatatatttttttctttttttttttgagacagagtctcgctctgttgcccaggctggagtgcagaggcgtgatctcggctcactgcaagctccgcctcctgggttcacaccattctcctgcctcagcctctcgattagctggaattacaggcatgcaccaccacgcccagccaacttttgtatttttagtagacacagggtttcaccatgttggtcaggttggtctcgaactcttggcctcaagtgatccacccacctcagcctcccaaagtgctgggattacaggtgtaagccaccgcgcccagccaatattatatttttactggacctcttctatgtttagagacataaattcttgccattgggatatagttgcctacagtgttcagtacagaaacgtgctgcacaggtttgtagcctaagagcaagagcctgtaccatgtagcctgggtgtgtccatctaagtttgtgtaagttcactctctgatgttcacacaacaacactgcctaatgacacatttctcagaatgcatacctgccactaagtgacgcatgactaattttttttttttttttttgatacaggtcttgctctgccgcccaggctggagtacagtggcacaatcttggctcactgcatccctgaccttccgcactcaagtgatcctcccaccttggcaccaacaccccaccccctgccccttctcacgtagctgggactactggtatacaccaccatacttggcttttttttttttttttttgcatttttttgcagagttagagtttcatcattttgcccaggctggtcccaaactcccaggctcaagtgatctgcctgccttggtctcccaaagtgctgggattacaggcatgagccaccacacccagctgtgactgtacttcttgctcaatgttttttattatcaggaaaagggaagggagctcattaaagacaagtcataaaggaatcagattctgaaggaacaaaagtttgggttatctcactaaggctgtaaaaaaacaaaaagggctggccaggcgcggtggccagcactttgggaggccgaggcaggcagatcacttgagcccaggagctagagaccagcctgaacaacctagtgagacccccctctcaaaaaaatacaaaagctagccaggtgcactggctcatgcctataatcccagcactttgggaggccgaggcaggcagatcatgaggtcaggagttcaagaacagcctggccaacatagtgaaaccccatctctactaaaaatacaaaaattagccaggcgtggtgatgagtgtctgtagtcccagctactcgggaggctgaggcaggagaatcgcttgaacccgggaaggctgaggtgggaggatcacctgagcctgggaggtggaggctgcagtgagccgtgattacaccactgcactgcagcctgggcgacagagtaagaccctgtctcaaaagagagagaaaaaaagtgttgctgcggagccagccgaggggaggggccataggatggcggctgaggagcgctgcctaggcagcatggctggggggcatccgtcagcgggctgcttccctcctgcccattcccaccccctcccaccttagtgaagaggctggcagtgccgggctctcagccttcaggttggtgcacacacagtcgagggtgatgggacgtcatttgccctgggtgctgaagacacagggcaagggtggagaccaaaggtcagcagggtggatagctgctggatagctgcctctgcccctccagacccactctccatcctgctctgtaccccaggtgggctgcgcccacaggccacctggccccctgactgctgggtttggccaatggggcctctggcatgtggctgggagctgggggagagggagggaatactcgttccccacgttccccaggagctgcgccttggccacatctttcttctgaagtctggggtccctctcctcggagctcctctctccaggatccggccactcctccctcttgccgtcctcagaggacccaaaggtggaaacagctcccacccctgcctgacttgctggcaccctgcccacacctcggtaaggtggcctctctcatcctctcctccatcccctgcgtcagtgtgaccccttctgggactgcctaagacgcgacatgcacagtgacactcatagcggtgctcctcgttttaaaaacgaaagcttaggccaggcacggtggctcacgcctgtaatcccagcaattcaggaggctgaggcaggcagatcacgaggtcaggagttcgagaccagcctggccaatatagtgaaaccccatctctactaaaaaatatgtaaaaattagccaggcatggtggcatgctcctgcagtcctagctatgcgggaggctgagacagaagaatcgcttgaactcgggaggcggaggttgcagtgagctgagatggagccacactccagcctgggcgacagggcgagactccttctcaaaaaaaaataaaggccgggcgaggtggctcacgcttgtaatcccagcactttgggaggctgaggcgggcggatcatgaggtcaggagatcaagaccatcctggctaacacggtgaaaccccgtctctactaaaaatacaaaaaaattagccgggtgtggtggcgggcacctgtagtcccagctacttgggaggctgaggcaggagaatggcatgaacccaggaaggtggaggatgcagtgagctgagattgcgccactgcactccagcctgggcgacagagcaagactccatctcagaaaaataaaaataaaaataaaataaataaattaaaattaaaatatattaaaataaaataaaaataaaaacaaaaagctaagtgtccattgatagataaacaggtaaagaaattacggtgcatctatcacatggaacccatgtagcactagagacgtaaggcagggtcacttgttccagcaacccagagtggctgccacccacggcgtgcacggttctgggtgctgaggactccagggtgtcccttctggtctaggggcgacaggctgtacaccaggacacaggggagtaaaagagagaatctgggagagggatgagggttgcgaggacagcggatggggcaactggtgtgtgaggggtgcctgccttacagatgggggacgccaggaagcctctatccagcggcgaccttttagggagatgcaaacagccaggaggagtcagccctgtgcggccttccaggcacagcaaagctcaggacacagatgggagcagaaggtggctgccctgggatgctggggaggtgcgcagggccagtcccgcaggcctggacgagcacggctgggcctcacaggtgggagtctctgcagctcccccttccctgcccggcatggaggagtccccaggcctgcggccatgtgaccctgccattggttcctagggtttcctgctgcctgactctgcggcacttctgaagggtgtctctcctcctcattctcaacatccatgctgaccacattgaaggtcaagggcgtgggccaataccctgccagggccaggtacaaagagagtgcccacagaaatgtctgtgagatggaaggaggcagagagccagtgatgagggaggcaggaggggatgcaaggggccataagtgctgcgggaggtggggggccatctggaaggtggctgggtgcatcaggtggtggggtagggggggcgacagcctctctcctcctctttgttctgctctgcagtggtggtggtgggccagggagtcaggggagccattatcttggaggcccaagtagccagggacaaatgcatagtctcagagagccaggaggccggtcctggagaccccaccagggcccaggagaggggagccaggctggagacagcctcggagcaaagctggactgtgggccagtggccctgcatgcaggcttaaaactttcctgtcaaccagggtcccagtaggaaagagctggcaccctcaaattagggtaagtctaggtgggtctatttggaaagagcccaatgagggggaccaccagggctggtgcaggaaggagctggcagcagcacggctgtcaccacccatgtaccacgtcttccaatgtccccagggccactgccacctctctcctggctgtgtgtctgggaggccacctgtgtgggcgccatcggcctgggtcgtctggtttgcacttggtgtcagctcctgcaagtcctgatggaggccgggagggagggaggagacagtagagggtgtcggtctcctggctccttccctgctgcatggcgccgggcagtgaccccggccagaagtcactgtcctgtccagacagccaagagtcagcgacgctgtctgctctgtgttccagtctctgcggccttcacttcttccttccagccgagggtggggccagcctgttctctcccagccccagggctggcggcgctgcccggcctacgctgtcctttctgagcctgctgcctgttgcttctaggcaccctggtctagccctggccacaagccctgccctcatgatcccctcgcaaatgtccttcagggcaacgccccactgcagccaggaatgttccctgcattgaagagcagtgaagccagcagggcccacctgagacgccctgtgggtcggggagagggctcacccactgactctgtgacctccgtgacctccagtgcctcccctgaaaggggaggaggagctggaggtcacaaagtctcccgaaaggggaagaggagcctctattgtcatcctcgtgaggcttcacggaggttgcgggtgcagcccgcagtcacactggggacagaacgtacagacagccttctgtggtgctaacaggcagcagccgatgacatgacgcaaggtgagaggctggaggcactgaccagcgccgcctgcgcaacccgtctgagtgccactgcgctcccctccccagcggcctcgcccagcttccctgggccgcccgaggcatctttcccgaggctggcgaagcaggcttctctcctgcccagaagcctgcctgggtcctcactgccttggggataaagcggggctcctgggcctccatccaggccctttggagcctctgatctaggatttcccttcccagagcccacagcacgacctgagggaattactcacgcccgggtggggcgggtgtggaggctgggccaggaactcaaggaggggcagatggagagggccgttaggaggtactaaggattcagtcatggctgcaaacactgcacatcaagcctgtccaacctgccgcggccgaacggggctcaggatgactttggatacagcccaacacaaattcgtaaacttcctttaaaaaaggccgggcacagtggctcacgcctgtaatcccagcactttgggaggctgaggtgggcagatcacctgaggtcaggagtttgagaccatcctggccaacatggtgaaaccccgtctctactaaaaattcaaaaattagctgggcgtggtggcacacacctgtagttcccagctactcgggaggctgaggcaggagaattgctggaacttgagaggcggaggttgcagtgagccgaggtcacacctttgcactccagcctggcaacagagcgagactctgtctcaaaaacaaacaaacaagcaaacaaacaaacaaacaagagcactcatctcaacagcctctgtgtgcccagcgcttccctctcacctgctcaaatagctgcacgtggccttgctcccctcctcactgtgcagataaggaaactgaggctcagagtgggcgagagactcgctcaggggcacacggtgaactgagggaggtgcctggacttcatctaagctggcgtggttggcagaggccgggcatcgcccctgagcatggagatgtccacagaggcttcaaggctggcatatcctgtctggggtgcggactgaggaggcccactctctgggagaggcggtctgaggacactcctgtccctctggccaccttgtgcttctcagagagtcgtctccagataggactggcggcagcagcgcctggaaacttgtttgaaatgcaccccagacccactcacccagagtcactggggctgggccagagggctgtaggcgattctgctgcacactccaggttgacagcccccgctgtgggctctagagtgacacctgcggtgcagtttccctcgagggcctctgctgttggccaggacaggcactcacctacctcctattcccagcaccaccctccatctctggtcagggcgaagcaagagtggagggagggaggtttggggacgttcagggtgatatcaagtctggacagctgccatggccagtccaccacctcccttgtctgagccaggggcagatcatacactcatcagcagattattactcatctgttaatgggtaacacctcggccccaccatgcaaggctgagaggccagcgtgagattctgcactgagcgggggtaggggtactccacaccccaggtctccatcagtcaccaccatcgtgggtctggctcctatccctccccagcattcagaggataatctccctacatggccttggacacccagctcactgggtcgggtagcctgaggccgggatgccaggcctttgcacagagactgtctcagaggccacccctcccaccagcgctttggacctttctccacctttacaccccacccagccaacccaggctgcacacccctcgggcgcagtgttggcactgagtctggtgaccgctcgctgggaggaaatgttggcctgcatgactgagtgacctgactgctgggaggccggggctgggggagacgggatgccggggaaatgggtgcccaggccaggacagagtgcgcacaagcagcctagcctcaggcatccgttctccctgactgctctggggcacagaggcagggcagggcccaggatgtcaggccccaccctgcagccatgatgcgggactgaggctagccgggccttgaatcctaccccaaacccccgcaggtggggccagggccatgaagggctggacccctatctccctggcggccacagtcacatctttgcccctagggctcaggggattcccttggaggcttttagagctcagcaagaatcagttcaacctgtggctgctggggtgtgggcgggttctgcatgatttgcgggcccagcacccatcatgcctgtccgcagggctcagcgcccctggtgcaggaggagagggagggcaacagggctcccctgtgggccgctggccttgggggttcctcccttggctctgggcttctccagctgtggttccagggcaagcctctttccctcccagtctcagtatgtgttcctgtaccgccccagtgctgtcctgggactggaggtctccaggccccagctggggtgtggccagtgtcaatgtagctgcagtgacggggtgtctccccaccccggcaccttcctgcctccggggccccgcagcccagtgcacagtgtcatggtgcactccaggacggagctctcccctcacaagctctgtgaccccaggcaggctcttcagcctctcggtccctggtttcctccctgtaaatgggatactacgccatctttatagggcttccatgattcagtgaagccatctggtttcaggccaattgcctggagagtgcctgctcacaggacatgcggtgtgagctgagctaggattatggcgtagctctccagcacacttgtgcactatacacacacataccatttccgtcttacccaccaccgtactaaggaggactttttaagaaggggcacacactttagagttaatgtttgttacacaaaggtggcccacgacaattagtgctcatttagcacgtgcctggcagcaggaccttgcccacctctgtgaacaggagctgccccttagtgaggtgagactgtgctggccacacggcaggacctggccatccccagagcttcccagctggaggctgccagctgctgccctcagcagtgaggagtcctcagaggctctggaagttacaaccctgaccctccgcctgagacctgagccctgccaggcctgtctgtgtgcacagcaccagggttaaagtggggccaagtagggcaggcgacaagcaaggtcccctgcggtgggcgggctgagggtggggcaggctgaactctgccagcccagggcgggccggatgacctcagctccgggtgacaccggtgggcgtcgggtgtggcctcagacagctcccttcctccccggctggttgccaggtcaacaccgggtgggactagcctctggtgtcggcagtagccccatgctcccggcctttgggttcttgcatgcgccgtccccatcacctggctgcccctctcacttccgtctccacctgtcccgggtcacctgtccttcaagccagaaattaaggacagcaccccctcccagaccgcctggctgcagtcccgggatgggcgctcctagtcgcctagatcgggcccccgctgagcccgatccccctccccgctccgcgccggagccgagctccctgcgccggaccagcaagcgcccgggcctcgacttccccttccgtgcaatgggaagcaagcctcgctttcctatgagcagggtgtcggctccgcgcgggccccggccctggatcctgcttggctttgcctggagcctcattctctccggctgtgccgggggaggctggaggcggcggcgagggggacaggagtgtcgcccggctcctccgcccgcggccgccgagggacgtggtcgggcgttcctctctcgagccgggagggggcgctggagcaccgggaacccggggccgttagcaccgcccctcctgccgacgccccgcctccggccgcgtttccccgggcctggtcccgctccgctccgcggcgcctcctctccgcaactcccactaggagggcagaccctcagccggagccgaggccgcgccccgcagccgcgccccggggctgcccctgtgggtggagcctcttaggacgacatccaaacaccccgggcgggcgcgggactcacgccgggaatcccagcactttgggaggccgaggcgggcggatcacctgaggtcagcagatcgagaccagcctgagcaagatggtgaaaccccgtctctgctaaaaatacaaaattagcctggcgtggtggtgggtgcctgtaatcccagctactcaggaggctgaggcaggagaatcgcttgaacctgggaggcggaggttgcagtgagctgagatcacgccactctgcactccaacctgggcgactgagcgagacttcgtcccaaaacaaacaaacaaaaaaacccaccaaaaaataaaaaactgaaaccgtattttttttttcgacagggtcttgctctgtaacccaagctggagtgcagtgatgcgatcacggctcaatgcaacctcaacctctccgggctcaagtgatcctcccacctcagcctcccaagtagctgggactacaggcgccgccactcctggctcctttttttttttcttttttgagacggagtctgcctctatcgcccaggctggagtgcagtggctcgatctcggctcactgcaacctccacctcccaggtccaagcaattcttctgcctcagcctcccgagtagctgggactacaggcgtgtaccaccgtgcccggcgaatttttgtattttcagtagagaggggtttcaccgtgttgctcaggctggtctctctctcgtgacctccagatgatccgcccgcatggtcctcccaaaatgctgggattacaggcgagagccaccgtgcttggctaattttttttttttttagatggagtctctatctgtcgcctgggctggagtgcagtggcgtgatcttggctcacatcaagctctgcctcctcggttcacgccattctcctgcctcagcctcctgagtagctgggactataggcgcccaccaccacgcccggctaatttttgtatttttagtagagacggggtttcactgtgttagccaggatggtctcaatctcctgacctcgtgatccgcccgtctcggcctcccaaagtgctgggattacaggcgtgagccaccgcgcccggccaatttttgtatttttagtagagacggggtttcaccatcttggccaggctggtcttcaactcctcacctcgtgatccacccgcctccgcatcccaaagtgctgggattacaggtgtgagccaccgtgcccagcctactttttaaaaaaaataataattttttagagatgggggggatctcactatgttgcccaggctggtctcgagctcctgggctcaagcgatctgcccgccttggccttccaaattacagtcgtgagacactgctcctggccataaaaaacccctctgaaactgggtgatttgtaacacatccagagggaaacgtctggaaactgctgtcaaccaatacttaggggctggggatttagtgtgggagaagacagctggaagtccttgcaccagggcttcctagcagggtgagatagtcccaggagaggctggaggcctcttccagtcaccttcttctttcactctccatccacccgcctggcccctccaacctccaccagggttatttatttatttatttattatttatttattatttattttttgtttttgagacagagtctccctctgtcgtccaggctggagtacagtggcgcgatctccgctcgctgcaagctccgcctcccaggttcacgccattctcctgcctcagcctccggagtagctgggactacaggcgcccgccatcacgcccggagaattttttgtatttttagtggagacggggtttcaccgtgttagccaggatggtctcgatctcctgacttcgtgatccacccgcctcggcctcccaaagtgctgggattacaggcgtgagccaccgcgcccggccccagggtcatttatttaggaccccctgcctgccagtctgccaaggggcacaggagttggtcctggacctgccctgtcagaggatcatcacgatcctgtggcatagggccacagtgctcacatggcccagcctggtggcatgagcctgtgcagtcccagctactccagaggccggggtgggaggatctcttcagcctaggagttcgaggccagattgggaaacagcaaggctgcatctgttaaaaaaaaaaaaagaaagaagggaagaaagaaaaaaaggaaggaagggagtagcagagaggaaggaaggagggaagcagaggaaggggaggaagggaggaaggaaggaacgattatatgtagcagagacatgcatataaaacacccaaaggaaggaaggaaggagggagggagggagggagagaaagaaggaaggaaggaagaagggaggaaggaaggaaggattatatgtagcagagacatgcaggtaaaacaccgaagtggtgtattgtcactgcgcagtccttgatgttgcccaggcagtctgcggtgtcttactccaagacggccacaagagggtactgagagcaagcctttctggcccagggccaggctttccgcttccagtggagcaccccagtagatgcagatgccgccctcacctccgttcttttttttttttttttttttgagatggtctcacttcatcgcccaggctggaaaatgcagtagtagggcaatcacggctcacggtagcctcaacctcctgggctcaagtgatcctcccaactcagcctcctcagtagctgggattaccagcatgcaccaccacactcagataatttttttcgtattttttgtggtccactatattgcctaggctggtcttgaactcctgggcttaagtgatcctcctacttcagctacccaaagtgctgggattacaggcatgagccaccgtgagcagcctgttcaagctttggaaggtgtggaggctggggagcagggctgggagagggtaacgatagcctcagtgcagccagaggatgtgagggacgctgcttcttcacttagtccaccccatgcctttactgcattggcagggatggggaggcccagagagggccaggggctccatagacacacagcagacgctgggcatggccaggcacagctcctgcctctggatctgccagtctcctgtagagaaaggcccatggcagtggcaggagagagggggagaagcagcgtatccgaggctcgaggcaaaaacgggccctgaggccaactgtgcagctcagctatgagctccaggcctgtctttacagatgctccctgccccagactcaatggcttggtggctcaagggacttgagcatttcctgagtaccctatgccccattgggagcaagccctagaagctgggaggcccctgcctaccaacaccttggatgacaactaacaccttaggtgatagttaccacttgcactaacaagttgggagagcaatttctgcccaagtggcaagggggcggggtggccttttgggggatagggcgatggaaggggagcatgccagctgactttctgacgtgagggtgtctgggtcttcagagggtgcggttgcagccacagtgataagggtgtgaggtgtctgacctactctggcattggtgtgtgacactaggccaggcccctgtccttctggtctgtgctcttgcctggagcagtgtacagatgtggggagccccttctcagaatgtagatgactggggttcttgtctgcctcaaaccctcccagagctccttgctgcccccacatcagggattgacccctctgctgggcattctcagctttgcacaatctctgctaccttctttttccagtctcacctcccgctatgcccacatcatcagatctcctgagctgcagccacagtgcccaggtcaggcctccacctaccctgctgtgatgcccccttgcccatcttcctcctggagaacttgtgcaaagagctctatccatcccacatccaggagaacccaattcgcattttcacaaagacacttctctgcctgacctggttctccgttttggaccattggatcgtgaatttggattgggtcttatttctctcaatgatcccagaatccagcattgacatggagtcaataatgcttaatattaatatttattaatacatgaatgtattgtttatgaatgaatgggcaaaagaatggtgagaagatggatggatgaatgatggggatgggtggcggtgagatgaagtgaggacagtggactgatgtttatgtatgtggataatataagaatataacttaagggtaatagatgaacacatggacgagttaattactaggtggctggctgattggtgggggatgaataactgtctgtgtgagtgatagtggatgaacgatggacataatgatggaatgagtatgtggtgggtagaagaatgtatggctaatgattggatgggcactggaagcatggtagagggtgatcctagatggtggatggatataatatgatggatggtagatgcatctatgtagttggtgattgattaagtgatgaagaatagataaatacacagtagattgatagatggaaaatggacggacgtggatgctgaattgttggatcgatggataccacatgaatccatacatagtggatataaactgcaggcaataagtattaatagtagatggtggatgcttagtgggtagatacatcatggaagtgtggatggatggtggataaatagtagtggatgattgtgatggatctatccacagagaatggatgggcagatgggacagaaataccaatgagtatatgactgatggatggatcatgagtggtggacaagtaaatggtggctgcctggtgcatgaatggggactggatggcaaataaatgaatgattgctagctggatgaataatgggttgtgtgctgtggaggtacaaatggaaggtggatgtggatagataacaactggatggaatctggatgactaatgatgaacaggtgctgagcggatggatgaaggtttaaacagtaggtggctacaacttggaaaagtgatgcatgaaagatgaatggtgggtgtgtagatggagaggtggtaaatggatgctttaatgtacagatggaggaagatggatacatagcaagtgggtagagtggatgatgaatgaagatggataccgaatggagaaagaataacgagtgtgggatgggcatgaatagtgactggatggatggtgagtggattgtaatggtcgatggataatggcaaataaatgctcactgctgtctctctactctgtcctcagcacctaaaacaatgtttggcacatagaaggcagtcaatatttttttctagaatggatgaatatgaatggatgctagatggtacttggatggattttggatgaatagtgaattttggctggatgatgggtggatagatagaggatgttgtgagatggatagtgaatgaatggatacgtggtggatatggataagagatggtgatggtaggctgggtgtggtggctcacgcctgtaatcccagcactttgggaagccatggcgggtggatcacctgaggtcaggagatcgagaccagcctggccaacatagagaaaccccgtctctactaaaaatacaaaaattagctgggtgtggtgggcacctataatctcagctacttgggaggctgaggtaggagaattgcttgaatccagaggcagaggttgcagtgagccgagactgcgccattgccctccagactgggtgacagagagagactctgcctcaaacgaacgaacaaacaaacaaacaaataaacaccaaaaaagagatggtgatggtagatggttggtggatggatggaggaatacagttaatagaaatatgaatggatggcaaatggtgaatgactggtgggtgaattgtagatgggtgacttgttgctgattggatggaggttaagggataaatcaggacaaatgaatagtagagtgatgattcacaattagatatgtggatggagatgtgaatggtagatggatgtgttaaatatctgatggaaagctgttacatagtgagtgatggatggataggtggtggatggatcgatggtgaatgaatgttggatcaatgggtatttagtggtgtattgatgcttggtaaatggtgggtgctggtggtgaatggatgggtgcatgatggatgggtggtggttgcatatgggatggtgactggagatggatggttaatggacattggatactggacggtggttgaatggtggattgtgaatggatggctggtggttgcatgggggaaggtagatggtggattgtggatgagatggatgttgggttattgatggtagatggtggactgtggatgggatggatgttggggtattgatggtagatggtggatggtggacgggatggatgttgggttattgaaggtagatggtggactgtggatgggacggatgttgggttattgaaggtagacggtggactgtggatgggatggatgttgggttattgaacgtagatggtgggccgggcgcggtggctcacacctgtaaccccagcactttgggaggccgaggcaggtggatcacgaggtcaggagttcaagaccagcctagccaagatggtgaaaccccatctctactaaaaatacaaaaatcagccaggcgtgatggtgggtgcttgtaatcccagctactcaggaggctgtggcagataattgcttgaacccgtgaggcggaggttgcagtgagccgagatcttcccactgcactccagcctggggaacagagcgagactccatctcaaaacaaacaaacaaacaaacaaacaaacaaacaaacaaacggacgtagatggtggactgtggacaggatggatgttgggttattgaaggcagatggtggactgtggatgggatggatgttgggttattgaaggcagatggtggactgtggatgggatggatgttggattattgaaggtaggtagtggactgtggacaggatggatgttgggttattgaaggtagatggtggattgtggacgggatggatgttgggttattgaaggtagatggtggattgtggacgggatggatgttgggttattgaaggtagatggtggattgtggacgggatggatgttgggttattgaaggtagatggtgaattgtggacgggatggatgttgggttattgatggtagtggtggattgtggatgaggtggatgttgggttattgatggtggatgatggatggcagatggtgggtctcagatggtggcgggatggcaaaagatagatgaatagctgtgaatggtagacggaccgtggctggactgtgggtattgaatggaagtgggatgttagataactgacggtggaggcttcctggttgcagggtaggaattacatggaccagagattatgcaccttggctcaggtgtcaggtctgtgcactgggctgaatgagacagcttgtcccagggctgttttgctcctttttgggaatggaactggaaagatgagaggggggctgaggggtgaccccctccccccccccccccctgcttcctgcagcgcatcccagtttgggtttttaggtttttttttttttttttttttgagacagaatctcagtctgtcacccaggatggagtgcagtggcacgatcccggctaagtgcaacgtctgcctcctgggttcaagagattctcctgcctcagcctcccaagtagctgggactacaggcacctgccaccgcgcctggctaatttttttttttttttgtatttttagtagagacggggtttcaccatattggccaggctaatctcgaactcctgacctcaggtgatctgcccgcctcggcctcccaaagtgctgggattacaggcgtgagctactgcgcccggcagtttgggttttttttttttttttggtcctttttactcctgtctttattccccaataggaaggagtcctctttccatgtatctggccccaccgaattctgcacctcaaatttctggacgccaatcttgaggctcagtctcaagtggccaggggcaggccctgggggaggggtcggctcaagggaagatgaggccgggcccttgctgggggctggagctgggagggcgcgggcgctgaggaccggcggccagccccgcggtgggcgtgagtgcgagggaggccgggagagcgcgtgtgggcggggagcgcgagaaggagagcgagccgggagagcgcggagccagcggagcgcggaggccccagcgccagcacccgcgcgggcggtgagcgtgagtgtggcgcagggtcgcccctccccagcctggccccggcagtgcgggccccgggagcgccctgacggctaggtgcggggtggttgggagcgggaggagcatggggggggatttgggagttttgagtcgagctccttggggaacgggacggcgtgggttcgcggggtcagcccggctgtggaacgccatgcctccgcgcgcttgtgtccccggggctgtgcccagcaagacctgggatcccgcggcgctgggggtggtgggtgccctcgatgtgtggtgccccggctggcactggaccctggcgccgggcagggcaaggcagcccttgggcacttgttccctgcttgcctgcccccgcctggctcaagctgacagctctatcatctgcctctgtcatccctctctctctgggccaagtgtcatctgtgggtctgtttctgtctctctctctctctctcttctcctctgtctccagctcagtcacctctcgcctggtctctgtggcagtatttttcttgcctctccctctgcctccttcccaaggctggctgggtctctgtcctggctgccctggactctaacctgagttctggggtcctgggatgggatccagaagaggcttgatggagggccggacctgggagcagtggggcactgagacatccctgggctttggggttgggcagaggagccagaggttgtggcttcactgcccgctgccccgagaggcctcctgcagtgtgtgcccctcctagccctccctgggcctcagtgggaccccagctgacctgagtggggtgtttggtgaaagaaacctcatttctcagaatagcagccctctgctttgctggcggccacaggaccaccctcacccaccccagcaggacgtcacaggcattccatcctgctggtctctgctctcccactgccttgtccccttcctgcagggctgcccccgcccgtggccccctactgcctgcatgccagccactgccacaccccacccccatttctacctctgaccagggcgtagccccaagagcccacacggcccgagcgcaggtgaagggtctggctggtgccaactcctgccaggggctctcttcccagagcccttgctgccagggctccagtggggctccccctgctgtggccagcctgagtgggtgcggccaagtgcaggggcaggacttcatttccccctgggctgtgggtgctgagggcctggcccggggtgtgcagggtgcatgctctcgaggaggaaatgggcaccttggcctctggctgacttgaacccagtccctactactcccagcctcccgtctcaggaacgtttaggtccctaggacactccgtgtccttcctgcactattcctgtctcagaatgtgcttctgtcctcccagctggcctagctacctcctgctcacctctcaggcctcagatcagcagacttcttccaggaagccttcccaggtctcccctcctgcctgtgccctcttgcaggcacactgtgcggccagggtccagtgccccctctggcggcgggctcaggcagggagcagtgcaatataggtccagctggagccatgggcactgggcctgggctggggtggagtggggtgggcttagcacctgaagccttcgggggagtgtggatccagcatcaggccaacagcagacaccccatttctgctcccagtcctcgtgcagcttagtggcgcagtggcggcagcagcatgagcaccccccggcctgctccaccacagccaggcgctgctgagggggctggaggcccagaagggaaggtatgcgctcgggaccctgggggggtcgggagggagcaagcctcaaactctgtcccatgacttggggcatgccttgccttgctgctggcctcagtttacccatctgggtgggggagatcattgcttatttatttatttatttatttttgacacagagtcttgctctgttgcccaggctggagtgtaatggcgtgatcttggctcactgcagcctccgcctccggggttcaagcaattctcctgcctcagcctctggagtagctgggattacaggtgcccaccactatgcccagttaatttttgtatttttagtagactcgggtttcaccatgttggccaggctggtttccaactcctgacctcaggtgatccacctgccttggcctcccaaagtgctgggattacaggcgtgagccactgtgcccggcttgttgctcttttataaaggtataatggataaaaaaaattgaaggccagcattcctggcttacttagcactccttcctgacctgaggaccccagggattgtccccaaggcacgctttgctctctgctgagtgaggaaatgccagggttccctgcccctagtgtcaccttttggcaggggatggggaggtgctgatgaaactaaaaaaaaaaaaacaagctccctacacagggtcgcagccttagtattctgagtgctagagcccagctagagcccagccattctccttgttggggagcagtggggctagagagggggaccagcctggagtcatatagggaccagtctggaacttggggttgcagacacagcctcccaggcagggtggacagaggtgagcaccaggactccgagctgcaaacgctgctggcctggacctcgttcaccccagtgggcagacttggagaggagcacccttggttgggggcaggaaggagaatggcacgtggggagggagagcaggctgggggatgagcccccctggctggcaatgccagcatgagggtggcccctgggaggatccagcctttggggtagggatggggtccctgctctgctgtcctctgacagctccttcattccacagacatcccagtccagtgacacctgttctcacacttgagggtcacatatggtccgtggttaaaagagagtctgggctggagctcaggaatgtgcactgttcagggatcttgctgcagtggccgagggccattcagctaagtcccccctgctgcgtggctgtccttcctcgaggcccttgtgctcttttgggaaggtggacccagcagcttcccttctaggtggagaaatgggagacagggagctccaggcagggccatctgcccgagcacaggcgtgggggtgggacagggcaggcaagtcagggccaccggggcgctgagggacagagttctgcacgtagcactgcagcctcaaagaccttgaacgggaggtggagatgctgagggcaccgggaaggcctggggacgcagcccccgcaggctcctgtgggcactgaacaatgagccaagagcaagcccagagccagccgtttgggttgccatggcaactgcttcccagctcctctgagcctggaggaggccaagggcccagcagggaagaccccaggaagggactggcaggagtctgggtgcaggaggcagctgggggtgcgcagaagcctgggctcattcctggtgaccttggcctctccggcctcaggctctggctgtgcaatgggcttctggagctgagcacagctgcgtcctatggtgcctcctgagagctgtgaccccaggggctgagcaccctacccccagggttgggactgggtagggcctgggacctgtctcagggatgttcctgtgtgaatacacatgtgcccatccctgccctggggactgggtgggaagggtctctgatctccctagtggggcagtgtgcaggacaggggtaggggggaataggagtgccaggcctggcatggccatgatcctgcccatcctccttgcaggctgtggcaggtgcctgggagaagggccctcggctgggccagcggctgccctcaatcgtggtggagcccagcgaggcggaccctgtggaaagtggggagctgcgctggcccctggagagtgcccagaggggcccctctcagagccgggctgctgctggtaagtgagggtgcctgtgggggtgctgagaggaggaagtggccactgccagggtcagaagcggggcgtgcttcctgcggctccagcaagcaaggccttcccgcctcctgcctgttcacactccatcctccgcccgccttggagtctctgcctgagactctaggtgctgcctggccttaacccccctccctagcaccgtcctccctcccacctgcaaatgaggtccctcatccactctcagccgcaggcctgggcacgggaggtgcacggtgcataattgttgaatgagtgatgccacattctcgcccctccttatccagtgcaccctcgtcatcacctctggagcaagtgtgccttgctcactagggcctgggaggctgtgagcctacaggtgcttgtggtggggggatgggctggcctgttggcaggctccatcccgctgcaggtgccctgtttaaaggctgaaagcaggccaggcgcggtggctcatgcctataatcccagcactttgggaggctgaggcaggtggatcagttgaggtcaggagttcgagactagcctggccaacatggtgaaaccccatctctactaaaaatacaaaaattagccaggcatggtggcgggcgcctgtaatcccagctactctgaaggctgaggcaggagaatcgcttgaaccctggaggcagaggttgcagtgagctgagatcgtgccactgcactccagcctgggcgatagagtgagactccatctcaaaataaaagctgaaacttctgggaggattgtgtgagcaggagggggcagccggcgccaggcccaaggaacaggagaggcagcaggctgggctgtgggggccttgtgaatggctctgagggccactgggggctgggcaaggggcatgaggtgtgccctgtgccctgggagatgttgtcccctggagacccctgggagtctattccctgaggaggaagtgaattcagccgcagctggggccgctcagcaccttgcctgccctcttcccatccccagacctcagcctgtactggccagaaaacccccttttcattgtggccagaggggttatctgtctggacccataacccccacctctgcccaaagcctcttgtcagtttctgcccagggcccaggacagcatcagggaccaccactcgggtaacccctgggacttgggctctggggatatccttgagtctgccctggacttcccttccctctgccaccccatcatctggtggatgtgggagctgcccctgctcgcagagcccagcctcattctgcctccctggccgagcacccctcccgcttctcatcacccgaggggacctcctggcctgccccagcccagttgcctgccaaacgctcatttcgggcccctgggatcctctcaggctgcactccccccgccgaccaacacggccgcctttatgtttctgcagccccctcgccgagtctgcccggagaaccagggaaagctgcagataacgctggcagcgagtgtgcctgctccgaggacccagcagccccggcccggggataggacaaggacgtggctgggctctgctgtctgactgctgagggcctctgccccagggtggccgggctgatgcacaggagggccgggcctgcccagcctggaaagcccagaggctgcttcctgtgtcacagggtctggaccgcagccctgccctcttctgcccatggcccaggtctggatcacaccccgctttgttccgtggtttgaagcagaaataaaggcacttcctggtggccagtaggcacacttgatggggatgcaagggactgaggacagtttgggctctgcctgtggccttccaggtgagggcctcagctcccagcccaggctggccagtccagagcgcctcttgggtgaccacttgggcctggcactggggcaggctgggcagggctgagctggctctgtggctggtgcctctgcccagggaccctctctctgctttggccaaggctgtccagggcagaaccagcctcctccaggtggcctcccaaccctccgtggggccttcttggggccagggccggaccctgagggcctgctacccacttgccccgggtgtaggaaagcacagcgatggtgcctggggtgggccgccccattccaggttggatctcgttaaatcttcgtgaaggtcccattttacacgtgtaggaactgaggtgcaaagcgaggtgctcaaggcaagcggctacggagggaattcctgaggtcaggaagccactgggctgccacagaacctgcatcagaggctggtggagcaggcatctcttcctgccccatgtgggggtcctgtccctccactgggtccatcgacattgtctctggactctgttctactacaggaggggagccctgctgcctggttgcagctggcatgggggcagagccccgagtgtaacccagggccccctccccaggtgtgtccccccaacctggccctctgcccttggccagcctgggccaggatgaggaagcttagggccgggcagtggtacactccataaatgtcagctgtgccaagtccatggcctttctgtggcccgggcaggtgtgccaggggcccatgagaggagggaggcaggagacactgcccctttgtgctttcccgctgcctcgccagcctccaggacgaagatgcacttttcagatgcactttctcccaccgccttccttctaaaaatagccaaccccccaatgcgggaaaggtgggaggtgaggtgcggaagctggcctggcagcccgcttcagttttaaaccgcaggaccccgtgggccctccccggactatagctcaggtgaggggtggggcggcccttcagtcctctccgtcctcctccagtccttcccatcggtcctgaagccagggagggagaggcttgaccaggctgggggacatgggggtagtgttgtgaaaggggacagacatctcgcaggatgccttgcaggcacgtgggatgtggggtgcagggaggccggcacgtgggtgggcgatgacgccatttactgagatttgatccccaccacacggctccggggtgagaattatgacatctggctcaacacggctgcccgggacccacacagccgagcggccgagctcgggcggagtcccagggcgcccacagcaccccgccagcgcgccccgtccagcagggcagcttttgggcggaggcgacccccaccgcaggtcccaggaccctgcgtgctcttgagccaggggtggagaggcccgaccgcggggggctgccccaccccgccgcccttcaccgcgagccggggcccagaccgcccagccacgcccagagcccgcgggcggagacgccaggggcggtgccagcgaggtcccgtccccggtaccccgtcccgcccccccacacgcggtgacctggggacgccccgcgggagtcgttctgcggctccccctggcgtcggctggggccaccgcccgggctcccacctcaaccctgcaatatggggttggggcagagtggtctgctgcccgctgcccgcagccgcttccggttagggagggagcctgggcctctgggtgctcacgctgcgcttaacgctggtcccggcagcagtgagggtggaagcggccgcctctggcttctacaccccgggtgtgacagcctggcctctcagtgagccccagatcaggcaagcatttggtggtgggggtcctgctccctggccttccctacctgggagccaggtcctcagccaaggtgaacccatttgatcccgacgacaatcccattttctggaggagtaaactggggctcagagattgaggtgcctctccaaggtcgtggggagctgggcttgccctctggtgggtgtccctggctaggcctctccctcctaacggctccccacccggccttctcctgaccccagaccaacctcgtgacccaggcttctttgagataaggctggggtttttccaaagggattttactgagaaacttcgggaaaacatggacatagcatgaaagaaacattgcaacctcatgctgaaaagcgggcacaggctcaggtgcctgtggagagcagatgggagttgaggggacttccaggagcagtccccaggccctgggcaccaccagcttttcaggcacctgtgtattgaatggagcgacccataattggaggtcccaggaccccaacatgccctgggagctggggggcgggtgggagaattagaccgggaagtctccagtccaccaaggcctggctgtatgggaagacccagtccacagagccagagacctaggtcgcagtcctggcctctctgggcacctgtgtggccgagagcaggtcactgagccctggggagccagccaccttggaccccggctgtctctgctcagttttgcttattccctgttacccctcatctctgcctgttggagacaggtggggtgggactcaggccagcaggtgggactgggctgggaggaagggcctatgggctgctgggcacctctcgggcttgaagtgggactcttagcaccccacttcacagagggaacccagggctcagggtagtgactcaagtggttaattggagggcttcctggaggaggtgctggcatctttgagtctaatttggcccctctgcagatggtgctgcagcatctcaggcaccttccagtctgttatgggctgcttttcccccataaaattcgtatgttgggctgggcgcggtggctcacgcctgtaatcccagcactttgggaggcctaggcagtccaatcacctgaggtcaggagttcaagaccagcctggccaacatggtgaaaccccgactctactaaaaatacaaaaattagccgggtgtggtggtgcgtgcctgtaatcacagctactcaggaggctgaggcaggagaatcacttgaatccaggagaatcacttgaatccaggaggcagaggttgcagtgagctgagatcgcgccactgtacttcagcctgggtgacagagagagactccgtctccaaaaaaaaaaaaaattcgtatgttgaagtcccaatcttagaatgtgaccttatttggaaaattccttataaaaacacgtgacctttaaagaggtaataagttaaaattaagtcattcgggtggaccccaacccatatgaagaggaaatatggacacagacacgaagtgggaaggccctgtgttgacccaggaagaagggggggcgctacccacagacccagaaaacagccccaggagaaaccagccccacacatgccttgactgtgggcctctggcttccagaactgggagagaataaacgtctgttgttgaggctcagtccctggtcctgtcgtggcagccctaggacactggatgcatggggccgtccctgccctcagccctaggatgctggtgcactggcctgtctctgccctcagccctaggacagtgggtgcatggggccgtccctgccctcagtcctaggatgctggtgcaccggcctgtctctgccctcagccctaggacactgggtgcatggggccttccctgccctcagtcctaggatgctgctgcacggggccacctctgccctcagccagaggatgctggtgcaggaggctatttctgcccacctcagcaccctgcagcagccccatcacacaccctggtggccccagcccaggttgggacaggcctggatccgttctccttggattttccctgagttgtttcctaagacgctcgctgcggaatccccctatgcaggggtgaggctgcctcttctgggaagtgtcagtggccctccctgcggcacgttgcccgcctgaccccctggtgtggggagtggggccccgcctccacatctttgcccctgcccaggatgccgtcccttctcacttctgagtgtgtcctgtctgtccctagggccccatccctttctctagctcctgaagcccccaggaatggcatgtggctctcaactgctgcctttgctgtcaccgtgagcttccctgacaggcagggtgcaggggtctcgggatgaactcgatggactggcccagtgctagagcctctgtcctggagggaggggtccttctgggctccggcactgtgggctgagtgtcccccgaggccagcgcctgcttccgctggcctctgagcaaaggagaggttggtggtgttttgggtggcaggcagcgtccaccccctgctgcctcgagaccctgagtgccgagctccgcagccttcccctcccttgttctctgacccttggactgagccctgagctgtctggaatggaaagctggagtgactgcctccggaacgaaaaggaagtgggaacttctctgaaagtgaaagtatggggtcctggtggagggtagggctgtgggtggggccgggtgggcctggcaggcgctgaccatggctgggaagtcccagctgttggtcactcgctcaggctgctctagaggccccatagccagggcccggctctgagggccccacgggccagcttctcagggggctgtgttcttcctgggccaaggctgcgtgctcagcaggtatgttctgggcaggtggagcaggagggcatggggtgctgtgggcgggcttgaggaccattccggctctgcgtgtggccttccaggccaagggcctcactcagagcccaggccgaccaggccagagggccagcgcaaatcacagtggacacacacacacccgatacacaggcagacacactcaggtagaaagcacagatagacagacacagaagacaccaagatgggcatgcaggcacagacacagactcagaagcactggcagaccctctggggacactccagggcagagtcatgcacatacagggagacactctcaggccaacacacagatgtgcaaaaccgacgcccagaaaagtgtgtatatgcccgcgcgctcaagctcaggcatcagattcactttcctggtttccccgggaaagtgccgagtactagccatggctgggggctgagtcaggctcactccctgccttgcgggtctcctggtctccaggctctgtaactgtccctccgtcatggcaggtgtgcccagggctgggatcaggcccacagcaggaggtgccgaacatggtatgggctcagctggtccgggaaggcttcttgggggaggagccatttctgctgagccttcaatgagttgacaactgaagaaggaggggctgaggtcattgtaggcagagaggatggcctgtgcaaaggtgtggaggagaggtgggtacttctgagtgatcagagtgagggaatgagttgggactgaagccagaggggtcattaggagaggccttgaatgccaagctaaggatggagctgtgcttcttccgagggcagcagcggctcagggggcttatgctttgttgctactgtgaagggaagtcttttaagtgtctctttctaataggctttgctagggtataggaaaggtgttgcttgtatttacataatcaatgcacaaaatttactaaacccttttattagctccaataattttcagcctcagattttctaagccaacaatcatatcacctatgaataatgacagtttaatctgctccttcccagtgtttacatctcttatttatttttctttccttattgccttaactagttcttccagccaaatgttgaggagtaagaatggtgagaacaaacatccttgtcattttccttatttgcaggggctggaaggaaaaggaaagcttgcaaggaaagctttcaaaggaggtttatagggccgggcatggtggctcactcctgtaatcccagcactttgggaggctgaggcaggaggattatttgaggccagaagtttgagaccagcctgggcacacataatgagacccctgtctctacaaaaaatataaaaattagccaggcatggtgttgcgcacctgtagtcccagctacttgggacgcttaggtgggaggactgcttgagtccaggagtttgaggctgtggtgagctatgatcgcatccctgcactccagcagtgggtgaagtgacacagcgagacctcgtctctaaaaacaataaacaaaggaggttgacgttttggcaagattctttttttttttgcaattgtaagatttagtagagtgaaaacagagctcctatacaaaaggaggggacccaaagagggtagctgttgccagctcaaatgcctgggtttatatcccgatcattgtccctcccactgtgctctcaggcgatagatgattggctatttgtttacctcctgtttttgcctaattagcatttctgtgagctctctttaatacctgattggtcgggtgtgagctaagttgcaagccccatgtttaaagatggatgcagtcaccttcccagctaggcttaggcattcttagtcggactaggaaatccagctagttctgtctcagtcccccctctcaacaggaaaacccaagtgctgttggggaggttggccaacgaccgtctaagtgctaggcaagattcttatgactgatccgaggaggcagcattgagggggcctgggaaggagagcagctcggaggctgtgatcaggtgaaggtggatggcaggtggggaagtgagaggggacaagccccgcacagggcttcggcccagggcacagtacaggcagtcacctgcaagaggctcctttggagcgttgaggagtggagcgatggtccagtcccagcgtagttggggaggctggggagtgggtgagcactgcagagtgattgggaggatgaggagcagctacgggagggaaggtctaggggaaagcggggagtagaagctgaggctgggggtagggagggtggggaagttcggacttgacttctcggacacagctagggtggcccagggtgggagctctcagtgactgtgtctctgggtggtttcttgcccctgctgctggccccacaaagggtgtattagcctgacctggggagagtgggacccggggctcaggccgggcgtcagtctctggggccttgcaatcagggagcggcagcataggagccggggccccctggactctccgggcactggggacagagagacgcagagagaaaagagagccagagagagtccatgggggtgtggggaggcaggcacagggacaggccaggcgagagccttgggaggtggaggggggagttgagaggggccttcaggtctcagccccgcaggcgccagcatggcagcaggcaggccagccgggggtggcagggcgaccctgataccgatgttccgcctgcttccaggctgtgctcaggggtgaccggggtagatggacagaggctgccagcccagtgcaggagggccacatcatcacagggacagtgccgagtacccactgagcagatagatggtgacggccggtggtgcaaggcatctgaaccccgaggtcctgaaacccaagtcaggtttggagaacaaacaggggccaggaaagggaatggccggaggggaagctggaggctgggcgtgcagccgggaggacagagaagaagctgggtggggtgcaggttgtccgtgaaccccaggggaagctggtgaggtgtcatcagcgggaggtggggggtggaggaaggaggttccaggatggatgcccggctgtggggctcgggcaggagggaaccatggaagggcttaaagcaggggagtgacctggctggacttttgctttgggaaggtcgagaatagcttgggaagctgttgggagctgcagggtcgaaggtggcatggctggaggctgaggggccatctggggacctcactggcccttcagcgaagttctggtttgggacaaaagcaggctgagtgacccccaagcctctgcctatgtaacctcctaagagattcaccgcacagctgcccctccttacccggcgctcgtctgggcttcctgggagagaacctccacatctgaccccactctgggacctgctgacaccttgggtctctccgccgggaggggagcttctgggcggcagttctgagtccctgggggtggagacgtggcaggtcccgcctctgctcccagctccaagcaggctccccagcctgagtgcgcggccaggggcagactctgtccctctgtgagcctcaggttcctcatctgtgaaatgggcaaatgacaacccctaactttgatgtcacagtagctgatctgtgtcaggcatcgagctgggcacacagtaggtgcttactaagtgtgagttctcccaaacaagaaggcggggcctggcttgtccttccccacatccccgcctccgtcctcttgacagcggtggatgcagcatgtgctgaaccgttctcttcacaacacccctgccctgctgggcgccggcccccatgccaagcatgaaggggcaccggggagagagaagcgagtggaggctgggacagatggtgccctgaagtgtgggtcaagtccgaatcaggcagggtccctgaaccctggcgctgggggaagtcgccgacctgtggccagggcggggctgataaagctccatcaatcacttgactgtctctccttcctcgggcctccatccagctgcttagccgcctctgggaacctcaaggaaggtaggtaggctgcagctgggcccagcaggcaccttgctggagggcgagggtgggtgggggtctgggccctgcccactttggtgtcattccaccgcagcaaactggggcctggggaggcacacttcctgcccgatgtcacccaagggttgggtggtgggtcaggcgggtgctttggtcctggcacctgggtggggggccctggggctgggctaggggcaggtccagcccttctttggccccagtttctcccagaggaaagtgaggttttgctggcctaatgccctcccccacccatggcccagcttgtgcaatggggtgggtgggaggcccctcccctctcccaacctaaagccaggaaagcaaacacagctcctaacgctggaagggggtgtgggtggagcctggcaggccacggtgccgagggccctgggggagcaggagcagccgcagctcagccacccccatgtccctgggacaccccctccattccctgtgttggggaggggccagagcatgctatggtggagagggagaggagtggggggaggaggagaggcaatgggtgggaaacagcattgagaacccccccagtccctggttaaatatagacccgaggctcctccttctgccgcccctgtggctgcatggccatgataagccgcagggtggccttggccactgccctcaggccccacacctcctcggcgggctctgtgacacccagggaagggggtgggctcccatgggggtccctgccctccccgttgagccaaagtagtcaggccttttgggctgaaggcgggtgagctgagggacctggagggcagtgaaggagctggtgggggctggggggagggttttaggcctcaggacctaacatctgggaaggcctagatgtggctgctggtcctgccctcgggtgttgtgagctgtggtctggactgggccccagaactgcatgtcagtgccctcctccaattctaatgggagggtctggcctggcagaggccgagtgacggtgggcacctgcggagaccctttttgggggatggtctcaggaaaggctcctgatggaagcagctgtctatatctccgtgcccagctgcggcctggcacactgagggctctcgccaagagagtggcctggtgatgcttccttttgacagcctgagggctgcctcctctggagagccttccttgaccaagcccctgggtgtggccaggccccacagggccacaacaggtttctgcatctgctcctatggccactccttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccagcaggcatccactggggcagcgtctgaggaactgaaacccgaggcaggtaagggcctcagaaacaacacgaagcatgaaaggaaacgggccagaggtcagggcagctcagctgaggtttccggaaaggctgtcctccctagctccccaaaccctgcccccgaacatgtgcaattctttatttatttgagacagggtctccactctgtcacccaggctggcatgcagtggtgcaatcacagctcactgcgaccttggcctcctgggctcaagcgatcctcccacctcaactttctgagtagctgggactacaggtgtaagccactgcacccggctaattttttttttttttttttgacactgactctcactctatcacccaggctggagtgcagtgacgcaatcttggctcactgcaacctccacctcccaggttcaagtgattcttctgcctcaggcccccaagtcactaggactacaggtgcgtgccaacacacctggttaatttttttttttgcatttttagtaagacggggtttcaccatattggccagcctggtcttgagctcctgacctcgcgatccgccccctcagcctcccaaagtgctgggattacaggcgtgaaccactgtgcctggcctaattttttaaatttgtttttatttttttgtagagatatggtcttgctatgttgcccaggctggtctcaaactcctgagctcacccaatcctcctgccttggcttcctgaagtgctgggattacaggcgtgagccaccatgcccagctggacaattgcactttaaattcttgcagcatctctgcaatgggagcccccccattgggcagataagaaaagtgaggctcagagaggtggagtgacttgcctcaagtctcacagcgtggagaatgggacctgaacccagatatgcatggccctagatccccacctctccatggcctttcacagcctggctcctggtcaaactagggccatgcacacagctgatcacagggttgcagagggtgcaaggctcgcagaggtaccaggaggggaggtcagggggattgcccagaggaggatacactggggtgggaagagggggacatggaggtggagagctcttgtcgggtggaggctggcggagagtggggagcagcaggaatgtaaagctggacacgggcaggacacgccctgcctgagctccgaccctattagacctgcaatcagggctgagcatgaggctatcaggtccggctcagccgggagtggaaggtgggtgtgggatccaggcggaaggtaggggttgacccaaattgctctgttcagccaggcttggggccccaggttctgcctcttcaaaggtgactctaagggagggctcctggcagctggggcctgttgttcctggagcaggccttcagctgtgctggggcatctggcagaggacagacaatccagccccgatggattgagccgtggcctgcaggtcttcgtccaggttcgggtcttggggcggtccctctcaccgcccttctcgcccgcctgtgcagaaggcaaatccgtggccgacctcattactgaacggcaactgctggcggccttcgaacagcttctgcgcctggagacgctgctggtggccgagaaggcctcgcgcacctttgagcaggaccctacggccttcgcgcggcgcgctatggacgtgtgcctgctttacgacgggctggcagccgagatcggcgccatcgtgcgcgagacgctggacagcgacggtgtggacgcggccgcgctggccgagctggcccgcgtggtgagcgcggaggaggaagcccacccttctccccccgacgacggcgacttcctgcgcacgccgcgccgctggcgccagcactgggaggaggcggtgcggcgaagcgctcaggagcgcgtgcggcggccgggcgcggggtgggccttcggggaggcggagggcgcgtcgggtttggcccagcttctggccgagctgggtggcttggttcgccgcgacctgcagaaggtgcggcaggaggtgcagcccgcgtatgcggcggccggcttcccagcgtgggaggtctatctgcgtgccttccacagcgccgtggcccagcgcctccaggagctcgcgcgcgacgcccgcggctgcgagcagctctatatcctgctggactgggccgccaacgtctacggcaggtgagtctcggccagggcgcccagtggcgaggacagctgccgcttcctccgcaggccttggggagccggctttgaggagcaccggacctttcttctctgttccctccctgggagagggctgagagccgagggcttcgacatgctttcctcggcgggttaggccgtggggcgctcccgccccaggttttctaggggtcacccatacacagttccagaatttgaaaagtttccgcggggaggttcccatgggagcagggcctgtgctggttccaccaggtgcctttgggcgcatcagaaaagggcacatcttggccaggcgccatggctcacgcctgtaatcccagcattttgggaggctgaggcggccgatcacctgaggtcaggagttcgaaatcagcctggccaacacggtgaaaccccgtctctacaaaaattagccgggcatggtggcacgcacctgtaatctcagctattccggaggctgaggtaggagaatcgcttgaacccgggaggcggaggttgcagtgagccgaggtcgcgctattgcactccagcatgggcgacagagcaagactctgtctcaaaaaaaaaaaaaaaaagaaagaaagaaagaaaagaaaaaagaaaagggcaccccgttaggccagacgggcatctgggttcagggtacagcctgcggggagcggccacctcccgctctctgcctgggatgaggatggattgccttccccgcggagcggttcccagccccaccggcaggagcgcccacggaggtgggggaggttgcctgaagtcccgcactccttaaattgctccttaaattgtgtggggtcagacccgtgtccgccctgctgtgggcctccgtgctgcgggttggagggtggccgattcctgagctgtgtttgaggagagggcggagtgccatctgggtagccgtccttcagcgttctgcaggaaggcaggaacccagctgtcagaggcttcccgggagggggtgtggcatggcagcctagaggcgcgcgcgcgtgtgtgtgtgtgtgtgtgtgtgtgtgtgtgtacagatgcccaggttcgggattggcgttagactttgagcctggccagaagaggggcagcggctgccgcatcagagccgctcccgcccccagccccctgccctgtcttccagtcctgacttcctgggcgccccggggctggcgctgcccgccgagccgctgcctccgctcctggcgccggacgtgtgggcccgactggagagcgactacaccagcttcctggaggtcaggccgggcgggtcaggctgggcgggccaggctggagggggcgggccctggggggatgtgcggcgcccaggctatcggcggccagagctggctctggttcaccctgtggcccccggcgcgggcttgtgacccgacagggcggccctcatcccggacggcgcgggacggggtctgggagggtctcaccacggcccatcccttctccccccaggccaagatcgcaagctgcttcgacagcatcttgcagctggagcagagtcactgggcggccgccgaggtccccgaggtgctgcagggcctctaccaggcgccgctgtccatggacgtccatatggtgcggcccgggagcaggggctgagaaggggcgtctgttcaagcctcacgcacacggtggcgatttccagaacgaattcctatccagtcccaaccaacccttccgttagatgggagcctgaggccccacgcggggggaaatcggggacccccggcgcgccgacgggcagggaggctgctggatgggagtttgcgggagttgactctccagttgggcggctgaaagctggaggggccaagactgacaggcacagcggggcgggctggaggcgcagcgggggctaccaggggacccgcggcctcaggtcgggggctgggaggcacgctcagtgcggggcttcgctcgcagctcgtggccgagcacgtgaaggcggccggcgccatctccgcggagctggaggccaccaccctgcgaatctgcacgcgggcgctcggcctcttcgtgcccaggtgcggacgcatcctcagtaggggagcgacctggccgggtgcgctctgcaggtgggagggaggagtctgcgtagggacctgattgggagggtggacccagggtcatcgcgcagctagggagggtccccaaaggctctgtgtatcccgccccaggtttgaaaaggcttttctggcgtcggaggcggtgagcgagccgcacctgggcgcctacatcaacgcctgcgaggagctcaggtagggctcgcccgctcctgtgcgggcgcagcgtggccagcagggggcgcgcgagcgccgggaacctggatggaggggagtgcgcgcgcgtggagggggcagaggtgaggagtgtgtgtgtgtgtttgtgtctgtgtgttggtggatctgaggggtgtgtgtgcgtgtgtgtgtagcagagttggggggtgtgtgtgcgtgtgtgatggagctgagggtgtgtgcctgtgtgtgcatgcgtggagagctgaggctgtgtgtgtgcgtgtttggcagagctgagggctgtgtgtgtgtgtgtgtgtgtgtgttggagctaagaggtgtttatgcatgtgcgtgtaggggtggagctgagtggtgtgtgtgtgtcagagcctagatgcgtgtgtcttgtgtgtgtgtgtccatccgagcaggggccctgggggagtgtggatggctcttcaaggctgagcagaggccgaggggttccagctccctgcctgctgccctgggctccatttttccctcccttcatcccaggcagcatttcttccatcttgggacacctccttctctgggaagcctccctcagcctgcaccctgggctttgctggggtgaggtctgggtctctgtgtccccagaaggcagacgccctccctgtgggctggcagtagctgttggccttccgtgccctcagctccaggccaggcctcagcagatgcggcagcgccagaggcacagactgagcctccccatctgggtttatccttttttaaaagtgtgtaaattttagtgtcccgaagtacttctcatttgtctgacttcaaagaacagctgtgccacctgctggctgtgtgctccgggacaagccacctcccctctgtggctcttttgccacctgtcaaataggatcagagcacctgctccctggggtggtgtgggacctctgtgcctcaggggactcagttcccattggctctttgtgagcacttctcagtgccaggcactttgtgggtgccttccctgcctgacacgtctcatcccaagcgcagtatacccacgcacaggtgcagagcacaggcctggaaaggaggtgccacttgcccgtggccacgtagccaggaagtggtggagctgggacttgaactaggcctgcctaaatccaaagcatgaccatcaggcactgcttctccaacactctcgtccttaatctgtgccaggcttgtccttggtgctgggaccctggggtttcagctccagggagcgttctctgccccttggtaggcagcctctggccaaacccttgatggaactccagcctgctctactgtgtccctggctgcggggactgcgtatagcctggccctcagtttcctcaacagtgaaatagggacatggtcaccttcagggggcagttataaggctcagggtagggtatgttccaggcatggctatgccgcactgtttatcaccaagagggatggaaggtctgtcccagagctgccagaggggaacgggtcagccacccctgacccacccctttgtgactggctccctgggcttctgtgctgtcccccacttgactctgctcgcagacagctacaatggggagccccacgggctgcccttcacattgtagtctaagtgagtggagctgtgtgcccggctctattccccagcctggtctcccttgcccacctcatcgctggtcctggcccctccccaggaccagtcttctctccaggttcccaggaacccaagaggagctggagaagcccctggtgacggccacctgcagcttccagaagcacttgcttcagggcttgcagcgtgagttgcaggtgactgtgataggccctctctccctacttcccatgcccagcaggcaccccctatttcctagagcctgggggcccaggtcacagcattcatttattccagggtgagctcatgggtgtgtgtgtagggtagtgggcaggggacccaggtgaggtcccagctgagcaggggcggctgggagacgcctgccttctcacttcagtctccagctcttagtggtcacccccgaagcctgggatggtgggtccacggatccaggcccagggtcctcacccagtccctcaaggcttctccagggcatgccctgagcagatctgactgcacagactcaaaccctgcccctagagcttggggcctgggagaggcattctgggaaagggctcgtgacataacctgtggctaggagagggaatggcaccccaaacccaggagggaaggggtcaggagtggcacactgggcttcgagggaggggttacgttgcgggcgtagtgcacatttgcagactcccagcccctctgtccccagccgctcttcagggttgtgtgcaccagggactggctgacgcaggactggctgcatcccctcatggacaaggtggtgaccttcgccggtcatctccagcgtgtggcccggccgcgggcacaggtaccacaagggggagggccctggcagggctgtgcccaggattggggctgttgaccctgaccctgaccctgaccctgggccgcccaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctggtaggggcggcatgactgcccttcggtgctcgcctctgtgtggggagtggtggcagtgactagggccttagcgccgggagggcttttggcaggagtggttctccccactctggatcaggtggaacagggactggggcgcctgtggggctggggggtggagggaaccaggtgggagggcggcactttgcatacatttgcatacagtttgcaggggtgcggggaaggggcgagggtcacagccccatctcacggtcagggcctttgggaggtgtcccccacctcaggccagagccctcagagtggaggcaccagcgcccctgcacacccctcgtctgccccctagcagtgctttcaggctggcctcggttttcctgtccaagcaggatgggatcggaggggagatgaaggctgtgtagccagcccatgagccctcggtgcccaggcacgctcccgttctgttttgggggaggcagtcccggcaccgagccagagtgactacaggagggctgacgctgcgggagggctgacctcgcactgacctcgcgctcttgcaggagttggagcagcggtggggagagggctgttggggcaggcggtggctctgtctcgcagggttccgaggccacatggttggaccaagccatccagtgcgtggctgagatcctgggcgagacctacaaagatgacatccagcggcacctggagactcttatccggagctaccccgacatcaggtgtgtaccccacctgcttccactagcttcctaccagagcttcagggccaagggggctggtattggagcaaccccagcccagacctgactgcccaggggcctgaagaccagaggcaggaggtaggccttggaccctcagaccctcaaggctggagggggaatggagagagccccttctcctaatctgctcttggccatcctccatcagccccaccaggggtgggcacgcctccagtcctggaatctgagggggaggcggaccccccacccctggggagaaagccctctctgaaagccaggggattctgagacctggtcaggaggaaggaggttttgatcccgggttgtgctggggggtcggtgagtcatccaagcctttggaaatcccagctcgaatctctccaagtccattcttttggagattctgggatgtggagctcacagaaagcccctggttcatccccttccccaggccaccctgccatggggtggggaaggattccccatccccagcaggcctgtcttccaggctgtggctcagagagagtggcccttacatcaccctgggagttcccctccaactactccccaaccccgttggccccgtcacccgcagctgcatcaccccctccctccctctccaccacctgtcccccggtctccctctctccctcgccaccctgtccccatgtctccctccctccctccctctccaccctgtccccgtgtctccctccctccctccctctccaccctgtccccatgtctccctccctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgcccccatgtctccctcctccctccctctccaccctgtccccatgtctccctccctccctccctctccaccctgcccccatgtctccctcctccctccctctccaccctgcccccatgtctccctcctccctccctctccaccctgcccccatgtctccctcctccctccctctccaccctgcccccatgtctccctccctccctccctctccaccctgtccctgggtctccctctctctccagcctgggtctctccacccggtccccaggtctccctccacgcctttgcgtgggctctttcccactctgcacacccctctcctgtgccccttcaagcccagctatggtgtcccccaggcccacgccctgccccctcccccagcacagctcttcctggcctcagtcaatctgacctccctgaccatcctggaatgcagagtgactcatactaactcccaagcccgtgggttcgcctcatgctggggctgggggtgttgcggaggtgtaggtctgcagtgagtgcccgcatgtctctgcaggcgggaccacatactggccattctggcgctgcgccgactgggccgccagcggaaccagcatctcttgcagcacactcaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcgggggggggcctcccgcccgactgtccagcttcaccctccagtctgaaagtgaagagcagagtatttatttaaaaaataaatgtgaattaaaatggtgcctccctaaggagtgggcaggggatgggagacctgggtcccggtgtgctgaagggccaggccggaggctgtctggtgacactatttggtgggtggccctctcatgcctgtggaagccacgggaagactgaggcaggtccagagcagggaaggcccatgcctgtggctgcccccaccacggcccggatccactggccttgtgcctggtcagccttgtcccagccaaagcagactcggggcttcctgggaacaaaaagaggataaggctggttctgcagcttgaagaatttgggttagatgtaggagggacttctcagcagtggaagttgtcaagttactgcagggggtgtgtcacccatggagtgtgtgtccgggggtgaccctgaggtgtcagcaatggaggcaagcgtaaggagactgctccagcgtgcacctgcgtccccgcttctctctgcaaagctgccgctgaaatttggcggcagctgcgggctggggtgctgggaaacctatttgcattggcagccgggctggctggggaggctgaaagttgagatggggagatttccagagagcagctgagacaggtggtgacaggtgcccctcccagccctccacagtgggcccccatagtgtctctgggcctgaccctgaccctggcgggagtggggggcaggtgactgcaggtgggccaaggttccaagagctccacaaacttgggtcgcctgaggacagggtaaggagtctgaaaggctgtggtgccaggcaagcagggggcgtgtctatccccactccctccaggccccctccctgcactgtggacagtcagggggcagttccccgggcagacctgccccggttcctatgccagggctggggcctggagcctgagtcttgctggggcctagagcctgggggttgagtgcctggggcttgtctgtctcttctgggagcaagtgctggggcagtgccctcctccatgggggcaccagggctggaggtcaggagcagggcaggccagggcaagggaatatccagacctcccctggcagggtggggcaggtggggcaggaatgaggaagtgggagggttggggttccccatctccagggctggggtgggggcaggtatgtgatgctggtgccaataagcggtcccgtccctgatgggaaaacaggctggcagatgctcaggatcctcccagccaggggccagaggggcatgtcttttcccaggggaggggtccaagagggggcaggtgattgacaggtcagcctgtcccctgcttgaccccacccctgacctggtggccatgagtgtcccaggcagggtgcatgggaggggagaagggagggcttggcctggtctggtcctggtcaggttctccccaaggagcccctgccacccccttccccacccttctgtctcaagctcctcactgagccacttggctggagccagagggtcctggggcagggctgtggggttaaggagggggttccgtcctggctctgccacttcccacctgtgagaatgcaggcaggttcttttatctcactgcttcattttttttccagctgtgaaatgggggtgctgttagtgcctcctcggctggggagggtgaagtcagagccagccataaggccgggggcctggcctccctgtgaccccatgttcccagaggcccacctacgggaaggccttgggcaccctggggttggggtggtggggtgctgaggctggagcaaaacctgagttgagtggaggtcactgggagtgggaggccccaagagaggctgggaagaggtgctgaaggctgagcggcttgtggcagagggagggggcccggcttagaccctgagggttcctaggcccggagacaggaagtcagggttttcctggcaggaactgtgtgcacatgtgcacctgtatctccatgccaggagggtgtgtatgccatgtgtgcagatcctcctgaacccagcggtggctggggctgggacttcccaggccaagccaggccgagctgggggtgggatggcagctcctagaggatgcagtcagggaggctgggggcagaggcggggctgagaccggggcaccctgggtgcctcagtcctggggtctggccactggcctttctgctctaaggggtggaggctgagcccatgagaccttgcaatgagcctgcagtgcttccttggccatctgttgtccaggccaagcctgcagggtgccggtgggggtggggctggctctcagagaggtacttgggttctcattggccaggtcacctggctgataagtgtgtgtgtgtgtgtgtgtgtgtctgtgcacgtgtacctatgtgcaccagcccctgtcagcacccccaggatggaggcccttgcctagtctcctcactcctctcagaaagcaggacagcctggaaccatcctacttgcccccaagctcagcccccaggccctgcctgccggcccctggcccgcagccttggccagtgcctgttccctgctgcatggcccaggtctcctccctcttcagggccagctgggcttcccccagtgccaccgtggcctggggctcctgcatgtcctggggttccctctggtctctgtccctgagcttgaggtccttgagactgggtctgctctgtgaatcttctggggccccaccccaggcccaactgggagggcagagagaaaccacagagaacccacatgccccagacccgcacactctggtctgcagagatgatccactgtgtgtgtgtgtgtatatatgtatgtatgtgtgtgtgtgtgtgtgtgtgtgtatgtgtgtgtgtatatgtgtgtgtgtatgtgtgtgtgtgtgcacacacacacacctgctggcccagcgacagcgtgtgtggggtgagaggagactggggagctgcctcccccagctcaggctggggcccagcagccctccgaggccatctctccctcctggtgtctgggcctggcccctgcttgagtgtgtcatgtgggagacacacgaggctgagccatgcaggcatgtgttccagtctcagctctgccccttctagcgggggacccagttttcttgttggtaacatgggagggagtgcccagtagggagccagtgaacctgttcacagcgttcctgacaagagggtgtgctgtgagtgacggtccgtgtgtcccctccaggcctgcacagcgtgccctcttccttcctcgcctggtgaccccagcccctcccttcctggcttcagtacccagtgggcccctatgcgtgggggcagcatccccagcggctggaaggttactgcaggacccctcactgctgcccacattgggagaggaggctgcagggtccccaaggctacccccgtccccaaacttccttcctttgccaccgcaaagaagccccagggccgccgtcggcgcatgcaactcacaggccatcatgaggcccaggggggtggccaggagtgggctgccccacaacactgcccgtccccccccttccctgtggaaggctggtcagtgggcacctgccggccactgtgctgcaacaagactgccgctgcagagggcggggtccacagtgccccaggtcacaggatcagatcctgctgggagccacccaaatctcagcctggcctcctgggaccctggtcttgggaaacacttggaggggagtgaaacttggacaagtcacacccacccctcggtccatcctctcctgggccctgggggcctgggcctctccagggacaccctcacttctgtctgcacatatgcccacccatctattagcagccttaaaaatgtgttaaatgcttaataatgtgttgggtagcaatacgttcacataggtcaaaatttaaaagatacgcaaagggtatagggtaaaaagtccccttcttatctctagtcttcctgctcccattcccagaagtgaccgaggttccttgcgggacacttgagttgttaaaaagggattcttgcccaagggatttatatgaatggtgacattctgggcattggtgaggaacctgtttttgctggaggtggttgacaggatagggcagtcgtttctttttttcttttcttttttttttttttttttgagatgaagtcttactgtgtcacccaggctgcagtgcagtggagtgatctcagctcatcacaacctccacctcccaggttcgagcgattctgctgcctcagcctcccaagtagctgggattataggcacccaccaccttgcccagctaattttttgtatttttagtagagacagggtttcaccatgttggtcaggctggtctcaaactcctgacttcaaatgatcctcctgcctcaacctcccaaagtgctggggttacaggtgtgagccactgtgcctggcctgggcagtcgttcttgatccctataaacatcaaatgaggaactcaaggctcttagacggatagaatcctcaaataatgggctcttagaatcttggggaaaacaaaagtcaccagtagagggtcgtgactgcaagttgtccatgttcttggcgttttgaacaaagaattggacaaaatgcccagcaaagcaaagaaagaatgaagcaacgaaagaacgaaagcagggatttactgaaaatgaaagtacactccacagtgtgggagtggcccgagcagcagctcaacagcccagatacagaatcttcttgggtccaaatatcccctagaagtttcccgttggccacttcatgctcacctcatgtaaatgaagtggtggcctgcaatcaacctgattggttgcggaaagcagccaaccagaggctgaagtgaagttacaaaggtcacactcctgtgcaaacatctgattggttgcaaaaagcaaccagtcagaggctagggtgaggccgggcgcggtggctcacacctgtgatcccagcagtttgggaggccaaggcaggcagatcacttgaggtcaggagttcaagaccagcctggccaacatggtgaaaccgtctctactaaaaatacaaaaaaattaactgggcatggtggtggacacctgtaatctcagctattcaggaaactgaggcaggagaattgcttgaacccgggaggcggaggttgcagtgaaccgagacagcaccattgcactccagcctccctagcagctgggattacaggtgcccgccaccacgcccagttaatttttttgtgtgggttttcctttcaatatagttctaggaagtaggaacgaaacagccttaggttccctgcctcctattctcctgcctcatcatgagaagctctgctgtttgtggggcgcccaccatgtgctttactctggtggtgtatgatgttcctgctttccctggactcagggctggcatttcgaatcagcttctggactcagacacctctgggctggaatcctagctctgcgccttcctagctgtgtgacctgtgtgagtcactccacctctctgggttccatctccctgtgtaaactggggaggattacacaagaaaatgcaagagttggctggaggagggcctggctctccaagagcatcctcctacctgtggcattcgttgttatttatctgcactacctcctttaagccatccctgccaaccctctgagtgtgccagtgccatctccaggaggtcccaaggaaatgtcactgtcccaagcaatgtatggaaagacacagctctaagcagtggagtaccagggcccaggtggtctccacgcctcagcccacagtgggatgccctccttctccaaagtctggaagtcagagctcctggctgtccggcaaggagggggctcccagaacctgggctggaggcagtcacagggcctgcgtggtttttgagcagcctctgttacagtagacagacgtgagcagggcaggagagcacctaggaatgtcacgcaaccatcaggtgataggcagttgttacactgtctctctaaaataataattggtcgcagccagcaccagggaaaggcagtttcccaacataggtgtttctcttacatagaagcacctagtactagtgatcagcaacttcccgataagatctcaggagtcgggtgagtgggctcaagcataagcactaagaggcaaaatggcagagcttaactcatgtatgaccttcctcgggaaaccctcgacgggtaagggaagagcgcctcacatgagcatgtgcaccacttcagtaaacacaccgcgcatgcggcccctcccaggtgctggcatggcaggccatggcggcgcgtgcggacagcccagcccaagggaagaatcctcagaaagaatgcaatggccccccgccggaagtggaagcatgtcaacgtataaaaccccaagtcaaaggtcaaaccacacactagaatccctcaagtcacccgcttggccttccaggtgtactttccttcctttcattcctgccctaaaactttttttttttttcttttttttttgagacagagtcttactctgtcacccaggctggagtgcagtggtgccatcttggctcactgcaacctccgcctcccgggttcaagcgattctcctgcctcagcctcacaagtagctgggaccacacctggctaattttgtatatttagtagagacagggtttcaccatgttggccaggctgatttcgaactcctgacctcaggtgatccgcctgccttggcctcccaaaatgctgggattacaggcgtgagccgccacgcccggccacttttttctttttcttttttttttgagacagtctcactctgtcgcccaggctggagtgcagtggcgcaattttggctcactgcaacctctgcctcccgggttcaagccattctcctgcctcagcctcccaagtagctgggaccatacccggctcattttttatttttagtagagacagggtttcaccatgttggccaggctgatttcgaactcctgacctcaggtgatccgcccgccttggcctccaaaagtgctgggattacaggtgtgagccagcgatcccacgatcccagcctttttttttttttttttttttttttttgagatagggtcttgctctgttgcccaggctggagtgcagccacatgatctgggctcactgcaacctccacttcccgggttcaagtgatcctctcacctcagcctcctgagtagttgggaccacaggtgcccaccaccacgctggctaatttttgtgttattatttttattatttggtagagacagggttttgccatgttgcccaggctctttctctaaagcttttaaataaactttcactcctgctttcaaacttgttgcagtctctcactttgccttagacttctcagttgaattctcttttctgaggaggtaagaactgaggttgctgcagacctggatggatttgctcctgctaacatacttcagtgcttcatgacttggatatagtctctcccggtaacacctcccctcccctcctcttccctcccctcccctcccctcctcttccctcccctcccctcccctcctcttccttccccttccctcccctctcctccccgacttccttctccaaacagccccatgaagcagcactgggcttcccaagagaggtcctgccacgtgactggcctctgtcattggcagaaccctgcataggccgtagctctgcagctgttttcctggaaattatgccggctccgagaagggcccatgttctacaggaaccccaggcagaagggaccggagctgcacttaggcattttgcatcagtaccagagagctgtggtgaaagactagagttttaggagagctgaacttggggaggagagtggccgcttgcagctggcatagagaacttcctatgcccatgagttccaccaggacccactcctccaggaagccctcctacaccacactatttggaaggccactggggttggggtcctgctgccccataggccctgctttctctcccatggcccttctccagcaaggacagtgggtcaggctcatggaatagctgcagaagccatacctcatcaggcctcggtttctccatctgccaaatacgaaaaggaatccttggcctggcttcctcctaggaggaaaggggcaggggggctatcaacaaatcgacagtgtcccgtggggctggggtggggcaccgcctgatggtacatgtctgggctgctgagggtcctcatgctccctcctttgcaggaggggatgtgccgtgaaagtggctcctggtcagctgtcctggccatcccacagtcccggaggaggtcagcagacttcagccagggtctcatggagctgtaggtgatgctgagcaagtcactgctcctcttggggaaggctgggtggcagcagggacctcaggcttaaggcctcaacctctgtgcctgcttctctgagactcagtttcctcatctgtcaacagggaacacaatggccccaccccatgcagacagtagggcatccccaggaagagtctcagggctggtgacagcctgagaagtgaaagggagaagcagggtgagtgttggggtcctgggaaccagggttagggcagtgggaagtgcaagtcatcatgcagagggaagtgggcccgggctgctgggggaggggctaggtgacccaccctgaggtcagcaccactcttgtgaccaaggctagcagctgcagccacgcctctggccaggcccagccacctataggccctctgcccctcgtgatcacccaccaccctgggccctgctccaggttgctctcccttctgccttcgactgccctcttcttccttttttttttttttttttttttttgagatggagtttcactcttgttgcccaggctggagtgcaatggcgtgatctcagcttaccgcaacctctgcctcccaggttcaagtgattctcctgcctcaggctcccgagtagctgagattacaggcatgcaccaccacacctggctaattttgtatttttagtattttgtattttgtatttttagtagagacgggatttctccatgttggtcaggctggcctcgaactcccgacctcaggtgatccgcccgccttggcctcccaaaatgctgggattacaggggtgagccaccatgcccagccccaactgcccctcttctagagagctttcctctaggtgccttcaagaatgcagagagagggccagtaatgtgcctccctgtgttattctctggtccgtgctgaatcggccttttctgctgccctacagggcgcaggtggaggtttaattaatggactaaatgaggtaatgaaaaagattgggaaaaatttttttcaaggtgaaaaaggagtgaaggatagtacctcccatttctgcatctaaactccttggtctagaagtcctttcttgtgtctgacttaaatacatcaagctgaatttcagacgctgagcaacgttggaggagaagcaagataacactgtgcttagtgaaggggctcctagcttcaccactggctggcacatgactggaccgctctgtgcctcagtttcctcatctgtgaaaagaagagagttagtgcccacttcattaggctgtccgatgaaatcggctaatgtatacaaaacacttagaacaacgcctggcaccggtggagatcaacaaacatcagcagtctacccaaaagaattgaaagcaggaacgtgaacagatatttgcatacccgtgttcttttgtttgtttgtttttgttgtgagacagggtcttactctgttgcccaggctggagtgcagtggtgcaatcatggctcactgcagccttaacctgccaggctcaggtggttctcccacctcagcctcccaagtagctggggctacaggtgcaccccatcacacctggctaattgtttgtatttttggtggagacagggtctcactatgttgcccaggttgatcttgagttccagagctcaagcgatccacccgcctgggcctcccaaagtgctgggattacaggcatgagccaccacacctggtatacacacccatgttttatagcagcactgtacacagcagccaagaggtagcagcaatcccagtgtgcacagagagatgaatgaatgcacagtgtagcccatccatacaatggaatatgattcagcctcaaaaaggaagggaattctgatacctgctaccacatgaatgaatcttgaaggcattatgctgagtgaaataaacctgacaacgccctcctggcagatgcagacacaaaaggataaacgctgtgtgactctatttatttgcagtacatagaatagtcaagaccacagagacgaaaggtagaatggcggttgccagggcccggaggagagggaaagaggagttagtgcatagtgggtagagtttccgttttgccaggtgacgatttctgcaggtggagggtgctgttggttgcacgaccctgtgaatatacttaatgccactgaactgtgcacttaaaagattataaattgcattatgtatattgtaccataataatttttaaacagtcagctgtcattgctctggcagacagaagggagggaacatcccatgtgtcgtagcctctgaggccctgggttgcgtgcgaggagctgaccgtggctcctggccaggtgctggcacactcgccttctaggctaaatggagaggtcattgccagtctgctcctgtctgctgccctccccaccaggcagagccccctgctcactgcccctggcctgtgccctggggagctggggaatgggacagccgctggccactggtcacaaacatcgccacccagcatgtgatgctggcttcctgctggggaggagccgtaggctggcctttggctcctctggaagtgcctggcctcttgggaactgctttctgcatctgcgagaagagggtaaggactgctcctgccctatgggccccattggctgtcatcccttgggcctccatgctgccccattttcagaagactttccttgtcttgaggacttcacgtatgttaccattgaccctcatgcctgagcttagagaggggaagtgactggtgcagacacaagtccaaggcagcagcctcgtttcccaatccccagccggtgctctgggcgggccactgccgtcagtgggggacaagggtggcagccccgcctcagccctgcaaagcccgtggagaccaggggctgccttcgaggggacagtggggcctaaggcctgacaacgccctcctggcagatgcagacttcccgagcaatttcccgatctgcttgggaatgggagggggggtgagggggtggggtgggggaacagagtctggcaggagaggcttgtggggattgcacaatgaggccacagcagccagccgtgaaggcagccaccggccagggcccctcagcccgtatcctcatcgcccctgtgtggatgaactccatctgcgcggtgccggtggaaggaccctcccagccccgggacaccgcggctctgtggactcatctgaaaaatgtcatccctggagtcctaggagagaaggggtggggttggcagccttaacgccccatcctgcatcctggcggcctcccgcatccgctcccccacaggttccccagagacaggatgatggatggcaatccgagtgcaaacctggcgcttggccagcactctggaagaggaagttctcagttcccagggcacctgaacccacagccgcccccactccgctggcccccctggtcctggaagacctgttactaggctgcagaaggggtggcggagtgatcagggggcggggaaagaggccaaacaaaagaggggaggagcagaggccccagtgaggcaggagggaagcccctgcccagcgggaaattcctaaatgtctgggtcctttccagagggcaggaattcctagcctagagtgtgaaataaggaaggaagtgaatctccagtgggttcccttcacagcccctttccatcctccccacatgccccacccccacatctcccaaaacaaaccctgagagacggtgtggatggggagacaggcctggaaacggaggcctgcgctgaatgggcaaagccgggttgatgatccagacgaggccctggagtctgggccttgggcccctccccttctgcctgctccggcagcctgtgggtccagccccagccccagagggggaaaggctccagtgggagtcccataggcctggctaggaaccccactccgctacttaaagtggtgtgagccgggtcagccacttcacctttccgcatttacgcatttcaagcaaggcttgacgaccggaggggctcaaggccctgtgcacagccgcgcggccagcactctggccagccttgtagcccccttccccttagggggcctccttcaggaagcccccgtcccctgcctccttgtggccacggtgacaccggaacacttcagaggggcggctggggagttggggtgggacgggctctcccgcagctggagccggtgtgtgacgcgggaacgcggccaagcgcgccccatccaggcggcctatcaggagccgtcgtcggacaatggctccgcgcctgacaaccccgtcgtccccgtgccgtcccccgaactccacataccatgcgacgcgcggccagccccccgcccctgcccggctgctgggaggaagtgacagcgccccgcatcccccgctgggcaggccgggcgcgcccagcccctgggacgcagggacacagccgggccgcgctgggccttggcctccgcccgcgggttttccgcggttgcggcggggcggggaaggaggggcgggcggggcggggctgactctgcgactatttcaggccttgcggaacccgggccaggacagtggcggccaggccgggacacggtaagtgacctccgcttccacacgtccattccccgccgctccgcgcggcttctcgcccgcccctaccccgaggccaggccggattccccgaggaaagagcctgtcgccgcggcggggacaggagggggctggacgcttccagggaaactgaggccctggcgcgcccagcgtccgcgcgtccgggcgcagaggggccaaggctggctgagggcccgggcctgccagaggcagggagggcggggctggggcaggcgcaggggtctcccctccattacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggtcagtggacctgaggagaggccgggcagcaggaggctggggggcgctgttgagccactggctgtgacccctctacgagcctcccagcaggccccttcctgcctcagtgggcccaaccagcggcaaggctcaaaggaacgcccctcctccccttcttcctttctggctgcaccggctcgctgctgcctgcaggacagactcaggacacaggagactcacccccactgaggcccagctaggcgcccagcacttggctgtgcggtttggccacatcccctcagcagcactgtggggtgggggtcctcatccccttttcaaagacggggaaacggcggcttgtgaaggaaggaggtgtgcagtccacacactagtgagaagtgtgctgagcccacaccgaaagcgtttctctttccatggcaccagctgcctcggagagcggagacctggggcgaggcccagggggctgcagcaggaccttcaggcgctctgggtttcgtgtcacagaggggagaaggcggtgatgctgtgggggtcctgcgggagctgtgcctggaggtgggacagagcctagtacatgtggggtgggacagggaaggctgaggtgaggctggcagggagcattgctggtaagggccaccctcccccaccccaggagaatggcagaggtggggcctgggcacccagggtggggctgagtggccctgccagacagaccagctcccgcgggtgctaggcatgcacctgagaggggctgggaagcgaagttggggcaccgggtggggagcagaggtgccccatggccttgcccctggggctccctggagcatgcccctcttggtcctggagtggaatgctcaacccaaatggcactagggaggccagtgccatccaggagtgtgggactctgcccagggcactgggtgagcatggcaggggctgggggtgggaggagcccaggcttcctgtccctcaggtggctctggccaagcccctccaggatggggacagggtagtggggctggtggaggcagcggggccatgggaagagtcggatgggcccagtctgagcctccatggctgctgtgcttggggcaaacacctcctactcagcctcagtttctccttctggatggtggatcatcctgcctgccttgcagggctgtttcaggggtcacttgaagttaccatgatacatgagacaaggctgcatgcatttagtcttggggtggggcagacaggtggcatcaaggttacaggtcaccccagttcttggggaggcccagcccctgcctgcttccccctttcagatcagccatgctcttctccagtggacctggccttgctctgacaatggtcaggtgctgggcagggactctggggaagctcgggtcttgcctctctggatgtagcttgcaggatagctggggatgtggaggcaggggaaagctgggctctgggaccgggtggcctgagttccaagcccaagctattgactatagggacagtttaagccgaaataacacccttccagatgagagaaaggaagagatgggatgggcacccaggaaggctgcagaaactggaagcctttgtgatgatgctacgatcccatttgggagggggtgggagccaggaagcctgggttctggacccgagttgctgtgtgacttcaggccgccctgtgacttgctgagccccttgccccagtgatgtgtgaaaggctgtctgaggtcccacccactgtggcttctgtagatcctggtcaggctctgcccctttcatggcccagctggagcagctgtgtttctgtgaccccaccgctggatcagaactggacaagatggcagaggggctgggtctgggcaggaggaggctgggttccagtctcaggccggttctggtgttctagaccccggcatgtcccagacctttctggacctctgttcctgctctgtccaaagggacagagcccatgccccgcctcttccctagggtcccgtgggatccagggaggtgtccattgcctgcttcctgcccagagggtgggctggcagggaaggatttgcccaagtaaagtgaaagtccccctctgtgtggcgggcttggcgtccccagcctcttccttgcttctggggctgtgaagtattggaaggggagctgtagatggtgagatgctcgtggccagggaggaagcacagttgttggtgctcatctgggccaggagatgagcagagccccggtggctgaatgggtgaaacagactgagtgtactcaatgcagccagcatagctgtgtgtccagcctgggagccagggccggtccatggtgaccactgatgccttcacccccaccccgcaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacaggtgctctaggaccctgggttagagctagtctggggcctggacggggttggcgctcatccgcgtgagtgagccacttgcacagtgggccggcaagtggggctggaaggcgcgtctgtctccctgctttcacctgtgccgcaatctggggggctgggaggccttcagcctagtcagggacaccgacatcaccctttagggtgttggccgccggccctgtgcgcgtctaggggaggacggtcccgcttggcgctggccgccccgcccggtgggcggtgggctggggccggggctgacgcggctttcccggcgcagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaagtgagcagaccaggggctgggcccgggccggcagggagggtgtcctctgtaggaggggtgtcgaggggtgtcgaggtgtgccgccggcagcttttagtgaggtcggtgtttgcagagttttgggtccgagaatgcaggggtgggacttggactccctggggcagagcctggacaggcagagactgggcctggacacagggataaggctggggctgggtctgcgttgctcttggaatccttaatttcctgggcctcagtcacattctgctgttggggaaactgaggcacagaaaatggtagggatttcattcacgagcgcccagtctgaggagggggcaaagcaatcaataaccatccagagctggaagggctgtggcagcagaggccaggccccgtgcagagcatgggcccaaagcaggcctggagaagtcagggaagccagcctggaggaggtgaaagccagcggtccttctctgagccagggaatcaggccaggaggcaggaggaggggtgatagggcaggtaggggagaaggtgagaggaaggtcggtgctcctgagcatgtcctcttccagggcactctggagctgagcagagctatgcgggcacccccaggcaggagagttccaagtgatgggctagggccacgtgtcttgttagacccccattgtgtagggttaccctgtgagcccgccgcagagctggagcccctcaggtgggaggctggctgtgcagctggtacccctgctgagtacagcctcaggcgtcccttgactccatagatccctgggcgtgcccgtcattcgcacggtctgcatggagagaggcttactgcagtgtggaaaggcccagggcgggggagtccaggggctgttattgtggggcttggccactgctggccccagatcctagtgtgaaactttaggaaggaagcctggaggtatagacagtgtgggcagtgtctgccgtctcgggggccttgggtggcctgtgggctcagttcgtgttgaagggtcagcctctggcagaaggatagagaaagggtccagtggagagggtgggagaggagtcagcagggcataggggaactggcacagggcaggggccacgggagagataacccagcccagagccagttcccgcttgctcgtcctgactcaccaggaaatgccgggcacctgcacccctgcctgccagtctttctgtcccagtgacctcggggtctgctggcctggggttagcaacaggcaactaaagccaagctgggcatggagccctggtgagagggtgcccaggggggcatcgttgaagcctgtgtgccagaaatgtggggaacggagggacacagctgcatctggattgggtgaggggcagagagaaggtcatttgtaaacctctaggcagacaaagggcccttaggaagtgccagggctgggcagtcccctgggagctctggggcgctgcagaggcgccaggacagtgagccaagatgcgtctgtggagcagtttggggcagcccttcctgcccattctggcctacccctgggattgggaggtggccggggctggtgagatgcccaagacctgcagggctggagcgcagtgggctgggagctggctggattccagggctgctgtgagtaggagcagggttttatctgggtgacaggtagtcttggagcaggaagaagatcagatcttaaaggtggctctggctgctgggtgaagaaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggggtggtgagagagtcagaggaggcatgatgacttcagagtttctgttccaaaccaaactaagtagatggaggacccatcatctgaaatggggaccgggtgggggtgcgggagggtgtgctgggcagtctgggcctgccagagaccaaggctgagggcctgggctctagcttgagtggtggtgctgatttggtatagttgtcctcatgccagcctcccctgcctgcagtgacatcatcaacagccccaagctggtgggtgagctgcagggtatggggctcgggagcctcctgccccccaggcagatccgactgctggaggccacattcctgtccagtgaggcggtgagtctccacctgggccagggaggggcagggaggcagcagaggagaggctcggagacagacaggacatgggcagggagcttgacgggtcttccaggtgagcgaggtgagggatagtgccccagtgacctgcccctcctcctccaggccaatgtgagggagttgatggaccgagctctggagctagaggcacggcgctgggctgaggatgtgcctccccagaggctggacggccactgccacagcgagctggccatcgacatcatccaggtactgcaatctgccccagggcacacgtaccgcccgtgcacgtgcatggggagccccacgcacattccgtcctgtgtgcatacccatgcccacctcggggcaccccctctgttcccgcctgtttcctccccgtcccctgcccccttgtccaggcgagcccctgctcagctcacccaccaccaccctgcagatcacctcccaggcccaggccaaggccgagagcatcacgctggacttgggctcacagataaagcgggtgctgctggtggagctgcctgcgttcctgaggaggtgggtgtgtgcccaggatggggtccctgtagccaccgctctcagagccacggcccctccctagtgcctcaggtggggagctgagctggatccccgccctctacccctgtccctgtcattctgagccaggagttgtttcccactcagccagggcactgagagcctcaggtggtctgacctccaccaggattcaacgtgggagcctcttgcgcccaccccatcagcaaagctctcagcagagcagcctctagcttcaaagaggataccccaggagggactgagaccccgccaccccttcatacaacactcctagtctccaccacctgaattctctctgctctctccctctcgacctctgagggcttctccagccaaccacacgctcactcctacctggtctcccaactctagagagggcctgggagcagcagagatgggctggtaccctcttcaggagcccaagccttagcttgtgaagccagttccatgatgcccaggggctagcggcccctcccttggctatgggcagccaaacagaaaagtgaaccccaggagctggcagggagggcagggaggctgctgctgtggtcccagtgtttgggctggtcctgaatgtgccccttctggtttcgccagctaccagcgcgcctttaatgaatttctggagagaggcaagcagctgacgaattacagggccaatgttattgccaacatcaacaactgcctgtccttccggtgagagtgttgggaggggcttgcgggagtgggagtcactcagcgggcaggagaggggagctggaaggtggagggaggaggagctgcttaggccaagaagtggaattcaaaccagcaacatgtgtgaggactccacggcctgcagcagcagcagcaaacatttcccaagtgctggctggggcaagcacacaggcagatgtttcacccattatcttatccttaaagcaaccctgtgaagtaggtatagtgatctgtctattaggcagatgggcaaaccactggaggaggctcacttgcccccagttacaaggggatgtagtggaggagtgtcctgagggcatggagaacatggatgggaggacttgatcccatagagaatggggagccattgagggttctagagtgaagagagggggctgtctggctccctgggtatggggctataggctgagcagggctggggtgacctctctgcctccaccttccaggatgtccatggagcagaattggcaggtaccccaggacaccctgagcctcctgctgggccccctgggtgagctcaagagccacggctttgacaccctgctccagaacctgcatgaggacctgaaggtagcgggagcctcttgccctcaggagcccagtgttggggggttcccagggagggactgggaggtgcccccagggaggagtggcagaagcaaagatgtggggaagacacgctccaggcctgtggacggcaccgtgggccagctctggtgcagcggtgatgcccggttggggaccctagcaggctctgaactccgccgatcatgtcctggggtttcacctgagaggggccgcctggggctgggaggggccgcctggggctgggaggggccgcctggggctgggaggggccgcctggggctgggagggcctggaaaagtttcactgcccctccccgattcagacacagcccagtcccaagcctgcagacacctttccttcaatcccctcagcccctcctatccacccccatccccgcgcctgactcccagcaactgaggctcagggtcatcggcagctggggttatatctgttatgggccaagaaatccacagaaaatgctgtgaaaacaagtagttcctttagcagggtgtaaagtggggggtctctcaaaaggaaggggagaggttctcttcccggtgtcagggactagcggccatgggtggcctgagtgtggtggaagcccgagcggtgaccccacatcccctggtactgatctccctggcccagccaagcacaaggtcttgtttatgaaggaatttatttatttaagtggcagtggacttggcctccgggccggcagacaggctctcctggctcctgagccgcactgggtgaccttggataagggtgcacagagccggctcccacttcctgtctgtgagcagggacctgaggttggcccgggttccctgggagtccttgagtgccccccgcccctccaccaggcacatgtgtcggtgtgtgtctgtgtctgcgtgtctgcgtgtctgcggctggcagcccttcctctccagggcgtgactagacatcctgcctctcctgtctcagccactgttcaagaggttcacgcacacccgctgggcggcccctgtggagaccctggaaaacatcatcgccactgtagacacgaggctgcctgagttctcagagctgcagggctgtttccgggaggtgaggaggctctgggctggtggctgggtcttggggagttgggggcagcccggacacgcacactagcacgtctgtgtacactcacgcacatgtgctcacacgcgcacatgtgaacacacgtgaatgcacgagcatgtgaacacgtgcacatgtgaacacacgtgaaggcacgaacatgtgaacgcacgagcatgtgaacacacacatgtgaatgcacgagcatgtgaacacatgcacacatatgaacacacgtgaaggcacgagcatgtaaacacacacatgtgaacacgtgaacgcatgcacatgtgaacacacacgcatgtgaacgcatgagcatgtgaacgcacacatgtggacgcacgagcacgtgtgcagtcttttgctctggcatctgcctctctctggaggcctggctacaaggcttcaagggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacgtaagccgctgcccacctctcccaagcccctctgaaatggctgcctcttctcccctagccctttcagggtcggagataggccgctggtgcctctctaagcccaacgagtcgctgacccgagcctctggacccctgggtccctccaaccacacccactcctgcagggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgtgccagtcactgtgtgaacctcaccaggggctcattcttgtggccttcaccacagcactacgaggacaatacttcccattcccgtttcacagaggaggcctggagagctcacaggatgtgtccaaggtgacacggctagttagtgtctggctgcatggcccacactcttagctttacctgacactgcctctcacaggggagactgagaccagagaggccagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttgaatgggtcttgacagggttgaccccagcttcgccaagtccagtccctgtctgatccattccacccattcattcattcacccaccatacaagcacccatctgctcatccacccattccttcacccatctggctatccgtctatcttctcacccactcatcacctgtctacccatccacccacccacccacccacccgtctatccatccatctattcatccacctacccatgtaagcacccatccacccatctactcatccatccacccctccacccatttagctatccatccactcaaccactcacccacccacccatccacccatgcatctactcactcatccatgctcccatccctccacccatctagctctcatccatctgctcacccacccaccatccatctacctatgccaccaacaattatggagaagtctgctaggtgtcagcctctgttctagttaccaggatgcaatgaagtacaagggaagccaggtctcagtcctcccttaagtagctcattctgttgagggccagcaatactaatgacataatcaggcaaagaaacagacaattacaagttgtaaatagggtttaaccaaggttgtgaatgataggaggtgccgactttagagacaagaaagccttttgggggtggacatcttagcggagacctaaggggtgggaagaggcggtcatctcagggcctgggaagaacattgcaggggaacagccggtgcggaggcctgaagcaggctggggcatggctgctcttgggaccatcaggtggagggcatgggtgagggagagtgaagtgcagccccctcgtgggccgggcgttggctgtcgggccctgtggcactggccgggagtgcagggagctggtgagtaggggtgtgggtgacaggctgggctgacaggatgctctctttgccagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtggctgtggagtgatttattttgggagctgcacaatgatggggggcccagccaggcagccttagcagctttctgagcctctaggggtccgggcaaacctacctaggttctgtgtcaatccccagcctgtcccagcccccagagcacctcatgtggtccaggcaggagatggcccaccatcccctcactgtgagcaggagctttggaagtgtctgcctgtagggcatggacagtcacttcacccttccgtgcctcagtttcctcatctgtaaaaaggggactgtgaccctttggggcttcctccaccgtcctttactgaggaagagggtggggtggacacggggcagccatttcaaccgcatgcacgggacacagagtgggaactgactcttaccatgctggcattgacctgaaagctacagctgtggacacaggaggtctggtttgtattcagagacgggctcagctgccacggaagggtgggcctctccgcagccaatctggcctggaatttgggaaggagcagagtccctggaagggaagaagggtaccttgatgaacgttgcacagaggccggggagggccccaaggggagccgtgtgcacctgaagaggggtgtgggcttcagcagggcctgggacagcccggagctgggggtgggggagggcaggccctttctcctgagttccattcttggggccaaagcggatggcatgaggccaccgtgcagtgagagaaaggagggagacgagggccaggggcagtgcggcttggcacggagaccctctgcccggctcctggacccgccggtccatgtggctgcgaggtcctggcctggttgagccacgtggggagcgtgggccttgggcgggcgagttcccgttcctctcctcggagcacagggtcagggggaagtgggggcagcgcgactctcccctgcatggccccctgaccctgggcaaacgtggggagagatggcgcctgagccccgatggaagctgtcagtgggccctggcacacattctcccacgggggcggacttaggtcccaaagtgacccccagcctcgcggcggccagggcgggccgagtcgtcggagcgcggcgggacctggggccaggtggacccccctccccgggctgcgtccacccctggcagaggggcgggctccgggcgcgaggccccaggcgaggaggaagagggtgcgggcggcgccttggaggttcctgctgttcctgcttttcggggcgggggccttccgggtcactgtcccgccagctgttggatctgcaccagtaacttctccaggaaaatcccccggagaggaggatctgcccggcggaggggagcgagtcccccagcgcggggacagggcgggcggagcggggcctgggccaggcctggtgcctttgtgcaaggacgggccccgggctgcccaggctcctgtgagcaggggtggagcggggaggccgcagcccccgcggaacaccgggcgcccccggcctccagcagtgggaagcagcccgggggctgacgctccctgcaggagccaggagcaagcaaacaagcagcttgagtgcaggcgcggggacgggccgggggtgcctgcgggtgaaagggcggctcaaagggacagtcgctggaggcccggtcttgaggaggtgcctggagcagacccgggctgggcgctgcgggggagggaggaggttgcggaggccggcgggcgggaacggggaggaattccaggtttcaggcaaagaaagacggcaggactggggaaaagggatcctggacaggagactccgcaggaggaaggagggggccggtaagtgggctccttccagctggggagcggggctggaaggggctggagacgcgagtttcaactcatgggatttatggcttggaaagacccctctgcccttcgggggcgctggggtccccaggggagagatgagggcggcagcgagggccccctcgtgcagtgagatggagcgagctctcggtgggctgagggaaagagcagcccaggggcttctaagagaccgggagggaaccaggctgcttccagggacagggagggcctgggaggggagaaagggctgaggaagcgcttggtcaagttcagggggagaggtccctccgcactcgcagttgtgccctgtgtcaccacgatgttgttcccaaagtattcttctggtgttttttttatttttattttttccttcttttcacaggtgttgacccaaagtattttctctcatgcctggccactctgccctggaccctcaacccagccgaatatgacacatctccagaaacccagcaggcgcaagccgcagggttggccttaaaatcctgcttaaacaggagaccctggaggcctgcttcagtgccaccagcctaaccgccagggctcatcaaagacgctgcccagatgcattgaacgtaagcaagatcagcaaaggtttatctcaacttcagactcactcccagaaactcactcttgggagctctctgtggaattgggccccccttcttctggtattatgttttcaaaactgacagggatatgaaagaaaaacttatccaggaaagaaaattgggttgaacatttaacatctcatttaagtcttgcaataatggctatatgtatttttgctaaataaatcttctattaatcttttttttttttaaagtttgagatgtctgcagaatgggcatgtggttcattagagtgaccaataccccggtgagtgacaacactttgtgtgcgaggctgccggccgccaggccctctctctcgctcactgctttgggggcatcattttgcacagcccctgtggagggtgatttgggcttccgggtcaggctgacaaatgcaggaacctgtgaggcagccattctccttccaggaatgtaccttatccatgctctaccagctatgcaaagcaacttgagtgccagactagtcacttcagttacagtagcaacatactggaaactccctaaatgcccatcggcagacaccagggaaatcactgcagtgcacccaaacaatggagtactatgtggcggtgaaaaagaatgaggaagttctctctgttctcatgttgacattcaggacacataacgttaagtggaaaaaagcacagtgcagagcagagtttgtggtgtgtgtgtgtgtgtctgagagagagagagagagagagagagagaggtgaacagggttggatggggacagaagttaggaaggaggtatttggccgtatagcttgtaaattttcattatgaggcatgtgaatgtgttatattattagcattttataactgaacatttaactgagaaaatgaaagtggtgttgctggagatgggaggagagaggaggaaaatactttagtgtctcaggggtaggctcaaccagccatgtccagcgcctctttgaagtgggttcatcagcaacctgtgacttggcgtgaagccaagttcagcgctgaggtgcagactgtaatcacagggctgagtttaaccaagactctggttttgtcaggcgatcactatggaggatgatagctgagccgtgggaggggcttgccagggagaagtcataccgatgggcgatacccatactgactgctgctatacccagcagtccctggtcgcccccagaactcccatcctctgaccctgtgctgccttgcagcccctcagccccccatgcatgccccccatgcatgcccccaccatccctgcagtgagaccccgcagcctcctgagatgccaggtaagccatgcacagccaggtgctgtgcctcagaacttgctgcaaagctacttatgcaaggcgggggaagccgtcctgggaggctgtgcaggtgagcagccaataaacaagtgaaaagaaacccccctccctccttgtttgtctctccagcgccctctactgacagtgcacagcaccgtgccagcaggagagagggaaaagttccagaatccccaagtagggcagtgaaagatgggcttgggtcagaggcagtagatggatagcaggcagttgctttccatatgcacccttttacacacgtttaaccttttctaaaaattccagtaaatgcaatacatgtatccttcccacaagtgaagatgcactcacgctgtctccaaaatgaggagacagtgaggacaaggtgccaatggttactgtagccactgttggctctgttaattacaccacaaattcaaccacagtccactgaatatcttgttacctgaagactgaatggtaacactaacctccaaaaaattgtgtgtacaatacagatgccagcgagagaaaacaggaaaatggttggcatgtggaaacaaacacgtgaaaacaagcaaaggaaactaagcaaaactactacactccttgcttccgtgacagttgggagccgaggcttgaagtccatggttccttctcccatcactcatcctggattttcccctccctcagccgggacctcagctagttggtgatctttacttgatgaaacaactaaaactttcatttcagaaggttctgagtcctcaattttcctgcctttctatggctggggtagttttccatgaaccttttctattggccatggaaatagtcagaagtgccgcagagaatgaatgccctgatttccagacatagtagcagctgcctggtctcccaggagaatcagaacctatcactgcagtcaagagagcaatcattttttaggtcttttggtgtcatgacagaatgagccccagatggccaggtggcggcatcatctttcaatttaatgaaaccattgctgtgtctcctggttgaaggatgttcctctccgggactaagaccttcacattagcagagctcaaagttgctgcgacaggaagcaaaaatcctgccagctggttgttattgggggtaatagtaagtggatccccctcatatcaactggttgcatggagttctaatcggggaagaggagtcaggctggggggagcagggaaagcaaaacaaacaaacaaaaaacagataagctataagcctgcctttctacatggcccaggacacacagagccctcctaagcaaataactcacaatcttcctgtgcccatcttatcgccagatcctcagccgatagacaagtgtcagttagctcgctgcaacctgggcattatcagcactgcgcgtggccctctccagcacaagcaccatcctataaaatcccccacaagtctttgtctccttgtagtcagctccccttttgctgatctgcccattgctttcttgcaatgtattttcctgtgttctctaataagcctgcctgtctttacctacaactctcttggtaaattcctttattgcatgcgccactggtcctagttagtcactacctgtgacagcttggtttctggagccatgcattttggctataagggaagtagaaccatgtggtggcccctgattcaaagcgtatatggaatcctgtaaaatagagtccatctttcctgggtattgccactcagtcttttgctgaggctagctccttctgggtgatagaataagcagtaagatcagtgaattccacggccacgagccactgtggcatttccttggtggtgaaatgggttccttggtcagaagcagccctgcatggaagccatgatggtgaaaggcatcacgtgaggctacaagcagcagtgctgcagaaacactctgggtaagggaggcaaagtgtgtcccttccaggaaggtgagtctgtgtcccctccatgatggaagagaccaggacccacctgctaccagatgctggctgctctctgtgggggaaggtgccatcaggcactcagtgctgctctctggggttgtgagagggggctgccagcagtgagattagtcagaccagcctggagagatgagcccgtgttgctgggcccatgcgtagcctccatcttggtcaccataaatacattgtttgtgggttcattgaaaaagcgctggtgtggctagggaattgtgtccccccaaattcatcttaaaatcgtaactcccaatgtggccctacttggagctagagtgttcacagaggtaatcaagttagaatgaggtcattgggtggctctaatccaatacgactggtgtcctaaaaaggggaaatttggagacagacacagggagaatgcagtgtgaggatggagacagatcagggtgctgctcctgtcagaggcattcgaaccagagtgactccatcttgaataggggctgggaaaaatgaggctggggcctgctgggctacattcccaggaacttaggcattgttagtcgcaagagtttacggttgagggagcagattaataatgtttactaacagacctggaatgtcctgatgtcccaatatcttgagaacgcaagcattcctagtttaagacgttttgttttaaagataatatcgattcttgtgaaagatggtaattacaaagattaatcctctatcacaaacccttgtagtaaagcacatctcctatgattttcgtatcttaaacaggcattgtacttaggctgggcttggtcctccttttactttaaggaatgcccttctctgtctatagtcattcttttttttttttttcttaaaaaatatatgtatatattttgggggctctattttacaggataatatatatatgtatgtatcttttgtatatatatttgtgttacaggccgaaagaatgagggtggtgatcagttcagtataccactggaggctctatgagtaaacagcaaactgtttctcataaatgcggaatgttggcaaactgacaaactgtgtctgccacccagaagggatgctgagggcagtcactccccaaacgcagtgtttcttgagattaggtacatctgaagcctgttagtaataacatgaacctgttatcaattagcagccgaccagtcattacctcctcctccctgctcttgctacccaataaatatgaagggctatggaagctcaggggctgcctttgtccactagaagcagggagctctcttcatccttccctggacagttcctttcaaacagtttcttttgtcttcagttttcatttctacgtttgtctcttcgttcagtcttgtaatgacggtctcaagtagtaaaagtagtaattgttgtggggatgatctcaagtagtaaccgtggcagtcagccacatatttgtatatatatatttacaggatacaaattatatatatatatattttaagacagagtctcactctgttgctcaggcttgagtgcagtggcacaatcctgactcactgcaacctttgcctcccaggttcaagcaattcttgtgcctccgcctcccgagtagctgggattacaggcacacaccaccacacccggctaatttttgtatttttagtagagatggggtttcaccatgttgaccaggctggtcttgaactcctgacctcaggtgatctgtctgccttggtttcccaaagtgttgggattacaggcgtgagccactggtccttgtcaaaaatatatatatatataatatatattttatattttatgttttatatatataaatataaaatatatatattttatattttatgttttatatatataaatataaaatatatattttatattttatgttttatatatatatatataaatataaaacaggcgtgagccactgggcctggccaaaatatatatatatattttatagagacagggtcttactatgttgtccagggtagtctcaaactcctgggctcaagcagtcctcctgccttagcctcccaacatgctgggattacaggcatgagccaccatgcccatccaggagtagctattctttcattcctttactctcttaataaacctgcagctaggtgtggtggctcacacctgtagtcccagcactttggaaggtcgaggcgggcagatcgcgtgagtccaggagtttgagaccagcctgggcaacatggtgaaaccctgtctctgtgaaaaatttaaaaaattagccaagcatggtggtgtgcacctgtagtttcagcggaggtgggaggatcacctgagcctgggaggtggaggttgcattgagccaagatcacgccactgcactccagcctgggtgacagagtgagaccccatctcaaaagataaaatacatagaataaaacaaacttgctttcactttgcactgtggaattgcctctaattctgtctcgtgtgagatctgagaacgctctcttggggtctgcattggggcccctttccagtaacacttctacaagccaagaaaggccagagattgacagaaaactcccacagctgggagacgggctgggatggagtctccctcacttcctcagaaggaggcaattctgctgacaccttgaccccagacttctaacttccagaactgggagatggcacgtttttagggcctaagcacccgcagcttgcggcactttgttgcagcattcctaggaaacacacagggtctggctgatgacttcacagaacttccttcttttacctgattcagcctcttctgaaggggacaccctttgctgagcatttatatgatgcgcaaatgttcctgtagtctgtgtccatctcgagaggctgaccgcatacttcttcctcagacatccttgttaccaaacttccaatccttttcttccaggtccccgaacatccaaccaaactgttagcagctgtttctaagtgggcacggatttgtacctctgggcatctctctgtctgcatgtagtggacagccgagtgaatggctcaaactgtgcgcctagggagggttccttcgctaccggggctcggccggtggagctgtagtactcatgtctacttttgtgggaactggcatagcatgccgagccctctgtcaccaggctcgagtttcttcctcagccaactgggtgtgaggagtacccggggaggctggaggcatggatggggaagggagacagggcagcaggggtaggtgctgagggagtctgggccacctgccttccctgtgaagttcccatgccgtctggacccaccccagcttgcctctactgcgtacatggactgagaggccaccgctgcagatcccacgcctggtggctgggtgggtccaaccatgcccggcccctaatgggaactaggctgaatgatcacctaatgacacaggggtgggcgttcagactcgaatcccagtagaaagcgagaagcagtttctcagaaggaaactagttatctacagaagagagcacagaattgctccacaattctagaggtccggactgcaattttcccattggcgcttgtcatggatatgttgagcagcagtggctcacagggctgggcggcacagaggcttgtacgcatagagcagcccaggcctgcagaacctcctcttgctcagcctcttatggaaactggctgccttatggggcactcgggagatgggtcatggtaacacactaaaatgtgttgggccagcctggtggctgacacctgtaatcccaacactttgggaggcttaggcacaaggattggttgaggccagaagtttgagatcaacctgggcaacatagtgagacccccaaaagcccttccaagcatttgcctctttcttcatagtaggtagtgggaggtgtagcaacttgccttcaccttagagtgaatatttcaaaattctccagcccaaataacccccaagaagcttagaaatcacaggtctcaaatttggggggatttatcccccatcttctagctgacatatgttttattaaagcttctagaggatgtgctatttcttatcagatccaatcagctttatatcaccaatgcagggggccagtgtagtggtgtgtggaatgttaaataataaagatcaatttggccaggcgcagtggctcacgcctgtaatcccagcactttgggaggccaaggcgggcagatcacttgagatcaggagttcgagaacagcctggccaacatggtgaaaccctgtctctactaaaatacaaaaattagccaggtatggtggcccacgcctgtaatcccagctacttgggaggctgagacaggagaatcgcttgaacccaggaggcggaggctgtagtgagccaagatcccgccactgcactccagcctgggtgatagaatgagactccgtctctaaataaataaataaagatcaattcatagagatggaaagtagaatgggggttgccaagggttggggacaatggggatttattgtatgatgggtgcagagctccagttttgcaaggtgaaaggaattctgaagatggatggtgatgatggttgcacgacaatgtgagtgtgctgaatgccactgaagtgtagacctaaaaatggtgaaaatcgtgagttttatgttatgtatgtttcaccacaatttaataaataaatacaaagtataaaggaaaaaaggaactgaagcatggattaaaataaaggattttcatgttgtttgactacattttagaaagcagtgtgttaggatcttgatactgtaagaatggttaagatactagcagcatgggtactgccgggaaaggttttagaaagtcagaatgcctgcctcagctgggtgcagtggctcacacctgtaatctcagcaccttgttagaccaaggcaggcaggttggttaagtccaggagttcgagaccagcctgggaaacacagtgagatctcatctctacaaaaaattagccagcatggtggtgtgtacctgtagtcccagctacttgggaggctgaaatgggaggatcacttgagcctgggaagtggaggctgcagtgagctgagatggtgccactgcactccagcctgggtggcagagtgagaccctgtctcaatcaatcaatcaatcaatcaatcaatcagtaaaaagaatgccttcctcagacctactagatcagagtctgcaattgtacaatccccaggtgactcatacaaattaaatatttatctgagctttttttgaagtataagatacaaacaataaagcttacttaaatacaaaaataaaagataacaaagccctttcagccggaaccgccgttttccagtaattcgccaaaatgacgaacacaaagggaaagaggagaggcacccgatgtatgttctccaggccttgtggaaaacatggaatttttcctttggccacgtacatgcgaatgtataagaaaggtgatactgtagacatcaagggaatgggaactgttcaaaaaggaagccgcacaagtgtcaccatggcaaagctggaagagtctacgatgttccccagcatgctgttggcattgctgtagacaaacaagctaagggcaagattcctgccaagagaactaatgtgcgtattgagcacatgaagcactctaagagccgagacagcttcctgagacgcgtgaaggaaaatgatcagaaaaagaaagaggccacagagaaaggtacctgggccgggcactgtggctcacgcctgtaatcccagcactttgggaggctgaggcgggtggatcatctgaggtcaggagttcgagaccagcctgaccaacatggtgaaaactcgtctctactaaaaatacaaaaaattagccaggcatgatggcacgcacctgtaatcccatctacttgggaggctgaggcaggagaatcacttgaacctgggaggcggaggttgcagtgagctgagatcacgccattgcactccagcctgggcaacaagagtgaaactccatctcaaaaaaaaaaaaaaaaaaaaaacaaaaaaaagagaaaggtacctgggttcaactaagctccaggctgctccacccaaagatgcacactttgtgagaaccaacaggaaggagcccgagctgctggaacctattccctgtgaattcatggcataataggtgttaataaaataaaagacctctggactgtaaaaaaaaaaagataacaaagatacctgtggactatattatagcagaagccaggattcatgtagttaagacacgaaggtgtactgttggccctgacaggtaaaagcaaattgtttttgcaaattagtatggaaaataagacattagctaggccaatagctgcataccaagtgccaggggccaggtggatttgcaccagtaaaagtgctacgtctgggacagcagccgcgagtgcagtcaaccacctgatcacgtttattacaggtcacagtcattctccaaggtttgtccagcatttgcatgggttgagctggtgggttctacggcatgggaatgtaatagatagccacatctctgcttctttcaagcctttagtggtggcattaatctctgcaattgcccagagatgcagtcaaggccaggatgagagggaagctagtgaggtaccagggcacaaaatggaaggatgtcaggatgatgccagagctgagcctgcactacattctgtgcccaagatgccttactatttttttttcttttttcttttttttgagacagtctcactctgtttcccaggctggagtgcagtgatgcaatcatagttcactgtaactgcggactcctgggctcaacaatcctccctcctcaaagctccctcccgcctgtagctagggctacaggcctgtgcctcattgtccagctaattaaaaaaattattgtagaaatggggtcttgccatatggccctggctggtctcaaactcctggcctcaaacaatcctcctgtttcggcctcccaaagcactgggattacaggtatgagccaccatgccaggcctatatgttactgctaaggagaccctcactccaaggctgtgcaagtgcagtgctgaaatttaacacacgaattcaccgttggtgggactgtaacctagaacaaactttacagaaggcatttgatagcttattttaaaaaaattaattccggctgggcacgcctgtaatcccagcacttggcgaggctgaggcgggtggatcacgaggtcaggagtttgagaccagcctggccaacctggtgaaacccatctctactaaaaatacaaaaattagctgggtgtggtggcgagtgcctgtaatcccagccattcgggaggctgaggcaggagaatcgtttgaacctgggaggcagaggttgcagtgagccgagattgcgccattgcgctctagcctgggtgacaggtaagactccatctcaaaaaaaaaaaaaaattaattccaaggtttcaaattgtcacttctcacaaatttgtttttttctgtgaattttaaatttttgatttacgtttttgccagagtagtacatcaacatagtttcaaaaatcaaataacagctctagaacttatattacaatgtccatcctgcgccccctgccaccaccaccccaggcagcccctttcgcctctacccgtgtctctggtccttcttgagttttagttttgaatgttctgtattgagttgttactatgtaggtcttgaacaattcttttaaaacatattaccaggtttttcatagttttaggcaatattgtgaatcagaccctttccccctaaaaattatctaactaggtcctcagtgtaaaatgtaaacctactgagtttttcatatttgtattataatcagtgacctttccagattgtgatatttgttctaagaggcttttggtttagtctctgattttctgggtgaacaatcctgtcatttgggggattatacattcatatatgcactgtgtcacgtctgcataagacacatgtaccctgtctaatggcacgtataagatgcgtataaactgctggtatgcaatcaattgtttgttaggggtgccaacaaatgacctaccgaggcacaacctgagagaggcaggcaggcgaagatcaaatataatcgtcattcctgaaaaagccactgtgaagaatgtggctgtcatctgcagccctcggctatgtgagcaccaccagcgacagacagatgatttaacgcagatgtgggcagcagtgcttccccccttggagacataagaaggagaaacactgaataaatgtaacaagttaaagcacagagaaatgggcttaataccttcacccatctgccagtcaggtgagttctccttcgcctgggataggggttggaaagggagagacagacgaggccaggtcacggctctggcggatcctacacagggacaaagcatgctggcaccccgctctgcccatgggcttcgtctccacatggcatcttggagcaattcctgtttttctttctgtctctcttttttttgtttttgaaagcagctgacagtactccattgtttgggtgcactgcaatcctttccctggtgtctgctcctgggcatttagggagtttccagtattttgctactacaattgaaatgacttagcccgggactgaagtcagtttatgggttttttctgtgtgtgagttttgtgtttttgtttgtttgtttgttttgttttttgtttgtttgttttgagttggagtctcgctctgtagcctaggctggagtgcaatggtgcaatctcagctcactgcaacctccgccctctgggttcaagtgattctcctgcctcagcctcttgagtagctcggactacaggcacctgccaccatgcccggctaatttttgtatttttagtagagaccgggtttcaccatgttggccaggctggtctcgaacgaactcctggccttaagtgatccgcctgccttggcctcccaaagtgctgggattacaggagtgagccactgcacccggccactttgcatagctgttagagaatgaataagatacattcttggaaggggaatggctggctgacaggttcctgcatttgtcagcctgatccatgagcccaaatcaccctccacaggggctgtgcaaaatgatgcccccaaagccgtgagtgagatggcctggcggccgccattataaatattaactattcaactaagatcagatggtagctggaggtgggggagcagggaaggatgagagggatgggtcacccaggcgcatggtgaatcctttggtggtggtggatatgctcattatgctgattgttgtgatactttcgcaagtatatacacatgtgcaaattaattaaacacatactttacatatgtgcagtttattgcatgtcagttatatctcaataaagttgtttaaaaatcataaaacattagttttttggtcccatcagattgtcaaaaaaataaacaaacagggtggccgggcacggtggctcacgcctgtaatcccagcactttgggaggccaaggtgggcggatcacgagatcaggagatcgagaccatcctgcctaacacggtgaaaccccgtctctactaaaagtacaaaaaattagccgggcgtggtggcgggtgcttgtagtcccagctactcgggaggctgagtcaggaaaatggcgtgaacccgggaggcggagcttgcagtgagcggagttcgtgccgctgcactccagcttgggcgacagagcgaaactccatctcaaaaaacaacaacaacaaaaaaccaagcaaggtaattgcctctagtcctggcaacttgtaaggaagccagctccctatctgtgaaagaatgaattggcatatggaattaacttttgaactattcatttgaaaagtgtttctgttctttgcggaagaaaaattatattgctcgtccttcagctgttataactaagatcctattaatgcatttcatttttgactgggtaaaaccgaattccatgggtttgctttttgcttctcaggtaactaatgaattttcagatcctctccttaaaaatgaaaatgtgcattaacaaaaaaaaatctaagagagggttaaagatttctcctttcccctgaaaccgtggaggagagatattccaaatgataaaggttgatcacagaatttgattggataaggtgtggaattaagaccatttacaagagtataaatcttgttttcctataggaaattagaacttgtgtgaaactttgtaactgttatcagctttccaatctcttgattaccatgaactgttattgaaacagaagagccttgcagtgtttctaaggctttagagtctgaggccatggtttttgaaaataacttcaaataaaaacctggaattctggctgggggcggtggctctcacctgtaatcacagcactttgggaggccaaggcgggtggatcacctgaggtcaggagtttgagaaaccctgaactcctttagtagagaaaccccgtctctactaaaaatacaaaattagccgggtgtggtggcagacgcctgtaatcccagctactcgggaggctgagacaggagaatcgcttgaacccggaaggcagaggctgcagtgagccaagatcacaccatggcactccagcctgggcaagacagaacaagattttgtctcaaaacaaacaaacaaacaaacaaatcctgggattctgcttgattgtcttgataacctgctgccttagtagccctgttataatcacatttctggattcttaagccatacaggtccctgggagagtcctcagaaaaacgagatggtttgcatccctgctgaaatgtttttaccttagtaaagagatttcttatcctaggctgggtgcggtggctcacgcctgtaatcccagcactttgggaggccgaggtgggtggatcacctgacgccgggagttcgagaccagcctgaccaacatggagaaaccccgtctctactaaaaatacaaaattagccaggcatggtggcgcacgcctgtaatcccagctactcgggaggctgaggcaggagaatagcttgaacccaggaggttgtggtgacccaagatcatgccattgcaccccagtctaggcaataagagcaaaacaccttctcaaaaaaaaaaaaaaaaaaaaagagagagattttgtatcttaataaagagatattgaacagtatctttgaggtaataattctacttgtagggaatgtatgttatcagaaataataggacaaacctttgtcattattcatacaaggattctcgttgtagggaaaactagaaactcccaaactatccagcaagaaggaaagaggaaaacagttatactacacaatgcagtgtggccattcacacaaggaggcagatctgtttccactgatctggaaaagcatccgtgacatgacattagtgaaaaatgcaaatttgtagaacagtatctgtgcagaatggctgtgctaatatagatgcgttggcaccaaaatgttcaaggggaaggggaaggtggcaggatccaatctgtacttcacgtaatcctttaaaatgtgtgggatggtgggtgagtcttctctgtatagatttttgcaaacaagatggtattttgcataaatatagtggggaaaggcatttaagacatattcatgcctgtagtgcttgagtaatttaaaatttcttattttgatatttaatttgaacattttctataagaagtgcttttaaaactagaaaaaaattttttaaagtctatataataaattcctacggctttacttaaataagggtgcctaggatttttcttgagtatgaacctgtcacatggctggttgtgtgctgaggccagagggtgggaccttccctgagggccgggctgggacatctccccacgaggttggtcagtccttctgccagctcatccatgaagagttcaacccaggtcagggccgggccctggcagcctggaggctgagcctggcaggcccttcccttttcaaaggccagcactgtcaggcactttggtccagactccaggcctgcagaggcacagagcgcaccaaggggggcagtgggaggggccagtgtgcgacccccaggacaggctgggaccccaggacaggctcggaccccaggacaggctgggaccccaggacagcctcagaccccaggacaggctcggaccccaggacaggccgggaccccaggacaagctcggaccccaggacaggccgggaccccaggacaggctcggaccccaggacaggccgggaccccaggacaggctgggaccccaggacaggctcggaccccaggacaggctgggaccccaggacaggctcggaccccaggacaggctgggaccccaggacaggctcggacctcaggacaggctgggaccccaggacaggctcggaccccaagacaggctcggaccccaagacaggctgggctcaggcttcacttgtcctgtgtcctctgggttgctctgttgttccaccatccctgatcccacagtaaaatcctgtcaccctcactgcctggtttctgcccctgttgggggtgaatgagcagcttgtcctgggtttggggcagagaggcctgaaggaggagcctgggctgggggcagccatgctcatttggggacagggcaggcttggtcagcagaggggctccccccccggaaggcagctgattctcagggttgggcagagtctggaacttcaagggcaggacccatgtcctaggaccaactctgtccaccctcccacatcctcccgttgccatgaccttggccccatctccgtcaaatagcctggccctcatacgtgcaggagccctggggtccttcccgagcccaaacatttttgcagtgaagggccctgcctagcttcaccccatgcaggcctgggcaggggcaactctgtcaggtgccctcggcccccaggtctttcccctgaaagcagcgagcatctcagtcgctcccactgcatgggtgggtggagttcagaagagtgggagaggaaggggaatgcttactttttccaaagcgatccaaggattgttctggaattgtttggcaagggctgtgtggccatgtgtttttctagattcacttaaagaaaaaacagtgttggggtccccaaggaaatagggcatccaggctgcaaggacaaaagccaggtgggctgaggggccggcggggccaaatctgtcacgaggaaggggaaactgaggcctggccttgcgggcccaggacctaccctgcccctttgcactgaagggagggaaggtctgagtccccgggaagcagaactggggccagctgggcaggggacagaagctgggtcacccctgggatacccaagcagagtgacacagcccctgggacggacttggctgggtctctcgtcggctcttttctctcctgtaagacgagaacatggaaaatccttccccaggagcgggacggcccagcacactcccccatagctggtggcaacgccctggaagtcccggctgtcacggctctgcctgcccctttcagatgctgtctcaatgacatgtgtccaggtcgagcctgttcaccaagcttcagccctcccatccctcaccctggggaccaagagacagctccagactagcccagtctctcccgagtgctcaggtgcttcccagcttcctccaaaggccagcagtcccagcgaagtcctgggaaaggcaggacagcctcaggcagctccagcgaaggctgtgaccactacagggagcacctctgccaggtggtggccccaaggactgcccaggactgtgggacactcagcttcccagggggagaggccccggcccactgtgggcagcacaaactggctgtagaggaagctctgggggctatgggagcccctaccccagggcacgcggggactcagccaggtccaggccttgcgggaggctctctggggagttgcagaggcgcagtttcccttccgcggagctgctttctcaccctagtggtgggacaagccctctcccgggtccatcccttccctgccccttcacccaggtcctgagtacttcttctgagccacgggtgggtgatttatgacccacttctcactacagaggaggcggggcagctcgctaacaccaagcaatgcaaaaagtcagtgcgagggaaacacagactccaacgtttttcaccaaagtgctggttgaaacacttttgaaatctgggaagtcttgtaatcatgtcaacatataaccttctttttaaaaagcacgagtttagtggcatgggcctgtggtcccagctactcaggaggccgaggtgggaggatcgcttgagccttggagcttgaggctgcagtgagccacagtcgcagcactgctctccagcctgggtgacagagcgagaccctgtctctgaaaaaaatttaaaaacttggagcttccgtcggacgatcccctcagatcaaggcaccgagttactttttccaagttacttggaaagattggccctttgggtcttgcatgagaactccattagatgagacccaagcagcatcaagcctagggttaactttccctactcctgagctgagacccctctgaggacccttaccaatgccaggtgaagcacgagttcttccactctggctgatgggaacaggcaactattcccagccttgggtgagcaccagacactgcgacttctaatcctttgcggtggttctttccccaggctcaggcaggttccccttacgcacgtactgatcggttctcggctgaacactcgtgggaaccttctgcagacctccggctccctctgtgcagcgctctgtcctcctgctccgccctgtggatcctgccacctaggcttgcctggactcccagctggctgtgctccgctcaggaggaggctggtcccgtctccttaccccatggcctggagactctccacgcggctagccgggcatctcagggctcaccccacttgattcccgttttccttcattgcctgacgctcagtgtcacgaaagctcgtcttgtagatttttctctttctcagggttgtttttttttttttagagagagagtctcgtgctgtcacccaggctcttgacagagtcttgacagagtcttgttcttttacccaatgaagtgcagtggtgcaatctcggttcactgcaacctccacctgccgggttcaagcaattcttgtgcctcagcctcccgtgtagctgggactacaggagcacaccaccgtgctctgctaatgtagagatggggttttgccgtgttggccaggctggtcttgaactcctggcctcaagtgatgtgccaacttggcccctcaaagtgctaggattagagatgtgagccacgcccagcctcaggtttttcagttgtttcagagcagagggtaaacctggtccttgtcccattttgaccagaatcagaagtcctctttgtaaaccaaaaatacaattctgaggctccccatccatcagaatggaccccacctctcagccagggcactccaaagctaacctgaaaaactggttcagaccatgccaggaagcagggtgggacatgcctcacgatgccctcctccctttgtgagttctggaaaagccaaccagtgtttaagatcaacacagaccttaagcctgataagaagtatttacaagctattctctctgaagcctgctacctggaggcttcatctgcaggataaaagctttgtctccacaaccccttatcataacccagacattcctttctattgataataactcgttttttttttttgagatggagtctcactgtcacccaggctggagtgcagtggctcaatctcagctcactgcagcctccgcctctcggattcaagtgattctcccgcctcagcctcccaggtagctgggattacaggcgcccaccaccacacccagctaatttttgtatttttagtagagacagggttttgccatgttggccagcctggtcttgaattcctgacctcacgtgatctgcctgcctcagcctcccaaagtgctaggattacaggcatgagccaccacacctggccgataataactctttcaaccaattgccatcagaaaaattttaaattaagtctacctataacttggaagtcccccacttgaagtcgtcccgcctttctaggctgaaccaacgtatttcttacatgaatctgattgatgtctcaggtctcctgaaatgtataaaacggaggctacgccctggtccccttgggcacaagggctgggtcatgggccatggtcacttatatttggttcagaataaatctcttcgaatctttcaccgagtttgactcttttcgttgacatcttatgtggtttaaaactgtgagagactgtcttaaaatctgaattgagtctgtttaactgaactgtcagagattaccagtgacttctgttgcaacaggaagataagacagtgaaccgttttgtttttaactatttctttctttcttttttttcttttttagacagagtcttgctctgtcgcccaggctggagtgcagtggcacgatctcagctccctgcaacctccacctcccgggtttaagagattctcctgcgtcagcctcccgagtagctgggattacaggcacccaccaccaagcttggctaatttttgaatttttagtagagacagggttttttcatgctggctgggctggtcttgaattcaagacctcaagtgatctacccgccttggcctcccaaagggctgggattacaggtgtgagccactgcgcccggcctgtttttaactatttctaagttttcacaggtctgcgaagaacaggcatttaaggagagaaatgcaagagttctctgccgctgaattcccccacctggcacatgatatgaggtgtgtgcatgtcgggacagttacaaagcctcactcaacacgaagtcaggatctcttccttctccttggctgccaggagtctgggagagccgaaatgacaatttagagcaagagtccatccacttttgcgttccctcctggccactgaaaatccgccgtgttctccccacaggagcaggggatcccagtgctgggttgtgctgcagaaacccccaaggggtctcctccagggcccagatgctggcgcagccctagccccagccccagcaaatcagaataatggggatgttgaataaagacccgagttttcaacaccccgtccctgcctgcagtgattccgatgatcaatcaggcgcgaagcccagagacccaggaggacgagtcactgactgggccatgagacaggaccccacagcctgcatccccacagcctgcaccccgacagcctgcacctcaacagcctcctgcctgcacccctacaaccttctgcctgcactcccgacagcctcctgcctgcaccccccacagcctgcaccccaacagcctcctgcctgcacccccccacagcttcctgcctgcacccccccacagcttcctgcctgcacccccccacagcctcctgcctgcacccccccacagcttcctgcctgcacccccccacagcctcctgcctgcaccccccacagcctgcacctcaatagcctcctgcctgcaccctgacagcctcctgcctgcattcctgctcacttctccagttccagtggaggcaaagactctgacccgtgagttctccagcactgaaacctgtgctcccagctccctggggaggaggctgtccctgcaatgaccccatcctagctgggctgtgtcattcttacagagggtaatggctctacctgcattcctgaggtttctcaggctcaggacctgtggaaagtgagccatagaatctgctggcattgcagagaggaaagccagacagccagggtcacagccactgtgacgtccaccctcggagtcctctgtctgccactctgaacacagggtagaagcagttattgcaaaacaaatgccactgtcctgtccaaaagtgagatgggtttggttccctacaaaacctcccgcagtgcatgctaggaaattttggaggaaataccaaacgtcctttcattcatggctgagagcctaatcaagggaaaactctattggccaaaaatgaaaaggagctgcaaagcaggcactaagctgacacagatgctacagtggccctggggagatttgctaggccaggtaaccaagacacttccatttcaacggccatattaggatggggaaccaggccttgttctgtgaaaggttagcactgacacccctgaatgaagcccgtaattgtgaagggctctactcacagtggaactggtggattaagagggaaaaattcctttttctttcaaaaagtgtcaaggatgaagcttgtcttggtttgatctctggaaagagaaaagtctctgtaacttggaagccaaggccagtcttcatgtcagcatgcagctcaaactcaccccatgtgcagttttaggaactgcaagctaagactctgacagggaggtgtgggtagccgagatgaccctgtttctagcttctgcacatgatgctttacatctggggtcttgattagcccgttcctagagagtaaaggaccagcctacacgcacgccaccatacggcagccaccaaaccagagctcctacccagccacctcctctactggctctaacactctgggcccgtctccacctgtcctgagcaccctagaaccaggtaccagacatctaggggcagtccctatgtgccagagcccgtgaaattattttattcatgcgtggcagtcttaaaccattcatcctgcctcacgtgttccttcctgcagaaaccctgataaaggctcttgcccatgtttttctgccctctctgcctcctgacagatcctggtacttccctgtgtggcccctctgtggcatggcccctgctcttggtacctgtgagtataacaaactatcttttcaatagtattgatgtaggatattttgctccttagttcagctaaatccaggttcttgtctcacgaccaggaaaaattaggcacatggacatattgaagggtgaagagagtggaatttattaagcaaaaggggaactttcagcagagagaggggtcccaccagccagctcctacctcacagattgaataccaggccaccatgcacaagctgaagaggccagtctccttcccagcatagggcatggattcctgaaggctccatccctttcttccagtgcgcatgtgagccgttagtctgagccacaccacattgatttatttcccttactgcgcatgtgtgaagggatggaatttttcactgagggcatgtttaggtgagccccctgtgcacagtgacctggacgggtcggagggtctctgaggacctttccttatcggcctaggcatttggctgtctactgcttctatcagtataacaagctatcttttcaatttgtttgttttctaaaacaaacaaccaaaaatctcctacattttaaagcagtaagaagttccccaggagcttcacacaaagggtgaagtctatggagcaatgtatcttcagtgtagacaggctgccaggatgcccttgggcacagctccagtgaaggggaacccatgagccatgttatagatcggagagggcacagacacctgagtgactgcctttagacaaaaaaatggactggggacgtctgaaatttccaactacaggatgacttgatagatacacaaagttaatatttaaaggacaaaatactatgtttcatttgtcatgtttaaattctattaaaatactagaaagatgggaaataactaaataagacttttaaaaacaaaaaagtatcatcactgaaatcaaatacttctggacacgtagaacataattttggacacagtgaattttggacacatgaactgcaagaaagatctgaagtgagactcgggatacagaatagaagtaccggggcacagagtccagtccagcagaatggagactaattctgtggcccggtgggtgtgtttctgttgtctctggcccctctttgtcctggcttccgtccttggtgtttggacagaagccccaccttgtacttgaacataatcatgatagggacaggaggcggggaaattctgggcagaagagggtgagtccccagtgagggcctcaccctcaagcctggaattatagcccaaagtaagaacatgcattcctgttttcccactcaaatgttgctttttccaaaaccacccatggcccacccccacccccatcctgcacccataaaaaccccaggcttcactggctccaccagcaaagagcagagaagaggagaagcagctggacattggagactatggttggacatcagagggaggcagcttgacttcagaggggcagcttgatggtgttgctttggagaggagtccagctggagatggctagacttggggaaaatcaccttccagctccatccccttgccagttctccttcctgctgagacccactttcactggcaataaaatcctccatgttcaccacccttccatttgtttgtgtgacctgatttttcctagattctgaacaagagctcagataccacgagtgcacatgcaaaaggctgtcacactgaccctctgccctcactggtggaaagcagccgcctcatgcgaaaaggcagagggtccactgagctgttaacacttaaaccatctacggatggcagagctgaaagagcattgactgtaacactccttcagggactttgggggtcatgggttccccccacagatgctgccacggggctcccatggggttttgctcctgctggcacccaaaagcactcaccccggctcctgcacctgctcacctgcatgctccctcccacgaggggttgagcacaatgggttcgaatgagtggagtttgtccctgccggcgccaaagtggccagctagctccagtgcccacactccagttcccgcctgtgaaggggtcaggggaaatttcctgctcatttatggggcctcatttgggatacgtcagcagggtgagtaaatgcgaatctgccagatctgtctcttcttgtcctcagactttgctctgagctatgccacttgcaggggagaggatgcaaccctgccatctctctctttcttttacgtaaaaggaatgttggctctgttcccttcatggagatctagccattgcctgggactggaataaagtcctggggccactgaaggcatctggtcgaggccatacctcggtgttgccagaaggccccaagactgtacccagttcctgactgcccatcagggggctggccaagacccccagaattttccatggtatctttcctttcttctttcatggtttgaaatagctcctatctcttctgtcataatgttaagggttttgctgcaaactgcagaaatattgctagagcatttggcccagcagtcagatatgcaattcaggacagtgtgatttccacttgtccttagaggtgccgtccccatccccagcccaaaagccacaggcacgtgtggcacatggtggccccctcctcacccccctcccttcctggctggggtgcttgggcatgtctgcggcatgcacatgccatgccaccagccatgggcagtgagagagaaccatggctgctgccagggccccagggcagtcttgagggcagggaccccgtgcagcctgctggccagtgtttgccactcgccgccccccctgccatgtgcccatagagtctttcctcccctggccagggagttcatctcggtccaaaccgtggaagggatacaatgattaaaggaacccgtttgcagagagcaagaggttcctcccacagctgtttttttctttccttttctatgcaagagggttattttcctgcctcagcactccgcttatgatggggaaacaaccaaggagccacccccaccggctaataactgcaagtttggcagggcccatcggggagtccatctaaagggacccatgcaccccctcagacacctttttgttccaaactcgattccaagttttgggctgaagccctagaaagaaaaaccagatctgagggatccaaagcgaggcaacgggcacagtgtaaatggtcaggacagattcctgctggctcagcccatgcttcatggaaggaggccatgctccatggcatagataaggcccagggaacctgagggctgccgacagtagtggggggtggagatgtgggtgagtgcagacaagtcctgttgtgtaggcaccccctgcttcacaggtgcgggccatagtggcacctgtgggtggtatctgtctaaaggtcgatgggtctcagggatcaaaaaacagaagagaaaagggggatgcttgctttctctctccctcacaccccaagtttttgccgaaagaaggaagggaaatgaggaatgcctatttccctgtctttccctgtctttcagaaccagctatcttcaccacccccagtctatactcctctggagtgtatactgaatcactgggactgctttgaccctcagattctggaggaaaaacacctcatagtcctctgtacaaaggcttggccaaatcatgatctgcaggaaggtctggcttggcctcaggaaggaaccattcattttgataccatcctgaagttggaactttttccgtaaacatgagggcaaatggtctgatgccccatatgtgcaggctttctttaccttgcagggtaatccagacctttgccgacagtgtaggattgatccatccctcctctttgccatctcaggagaggctgcaaggggcaatcccagggaactatagaaatgagccccggaggcacctccagcaggggagccagctcccaccagccctgctcctcccgatccacccggtcctccctcttcagcttctctctctcacttgccccctcctagaaatcctcaccctgggcaagccccagtgtcacacttgcccctccaacagatgcttggtgaatttggcccccatgaggtccaggtccccttctctctacaggacttaaagcaaatcaagggagatcttggcaagttttcagatgaccctgacagatatatataaaggctttccagaatttaacccaagtatttgaactctcctggaaagatgttatgttagttttcaatcaaaccctgagtaacagctgagaagcaggaggctctgcaagtggcagaggggagggatttggggatgaactttgtatcacatatagtgtcagggaaggggtcaaactttatccaactggaagagaagcagtagcattggatgaccctaaatgggatccccatgatgacatgggagaatggaagaggagacactttcaggagtgcataatggagggcttacataggactagcactaggcctctcaattacaccaagctatccatgattgaacagggatttgatgagaatcccactgccttcctggaaaggctaagggagcccttggtaaagcacacctctctatctcctgattcagtcaaaggaaactaatcctaaagaataaatttattactcaggcagtccctgcagaaacaggccctgggatcagatagtactttagagaacctcctgaaagtggccacttcagtcatttataatagagacagggaggctcaggagagagagagaggacgcgcaggaaagaggcagaggctttaatggccaccatgcaggtccacaaaccccagaattcctgaggttcagctgttaactgctacagacgtggcaagccaggggattttagaacgaattgccctggcagcatgaggaagccacttcgtccctgtccaatctgcaatggggaccactggaaagtggattgtccctgagaatgctggtctctgagtccagagccaatctcccaaatggtccagccagactgacagatcctggggctcctctccctggctctggtggtctagaccaccattagcattcaggagccctgggtaatcccggaaatcgaaggaaggaaagtggaccgcattctggacaccagggctggtctctcggttctcctctccaatctgggtccctttcctctgttagcacaaccgtgagaggcatctcaggaagacctttaacccaatagttctcccaaccccttagttgtagttgaggagacctcttgttcacacatacttttctaattatgcctgaaaacccaactcctctgttgggcagggatattctggcccatatggggaccaccatcctgatggccccaggacaaactctttatctcctccttgtggagaccaatattaacccagaagtttgggcaattcaagggaaaatgggccaagttggctgggtgccgtggctgacacctgtaaccccagcactttaggaagccgaggcagacggatcacctgaggtcaggagtttgaggccagcctggccaacatggcgaaaccctgtctctactaaaaatacaaaaattagctgggtatggtggtgcacacctgtaatcccagttactcgggaggctgagacaggaaaatcgcttgaactcaggaggcggaggttgcagtgagccaagatcatgccactgcactccagcctgggtgacagagtgagactttgtcaaaaaaaaaaaaagaaaagaaagaaagaaagaaacttggccaagccacaactgccatactggtctgggtccaccttaagttctccttttttaaccagaaataatattccctgaaaccagaagttagaaaaggactagaagccatcattgataacttaaggttgcagggcctcctcaaactctgcaacagcccttgtcataccccaatattgggggtacaaaaacccaacgaggaatggagactaattcaagacctccacctcgttaataagcctgtggttccaattcacctggtggttcccaatccatataccctgctaggtcaaatacctgaaggaactaaatggtttactgtcctggacctaaagaatgccttcttctgcatattgtacaccctttcagtatttgtttgcatttgaggagccctctaactaaaccactcagttgacttggacagtgttacctcagcggttctgcccacttgtttgggcaggcattgtcaagagacctctccaagttcctttatcctcaggttaaagttttacaatacataggtgacattctcctctgtgctccaactgaggcagtctctcaggagggcagaaaggctcttcttaattttctggctaacagaagatataaggtttcaaaatctaaatctcagctctgtcagacttcaatgaagtacctaggcctggtcttatcagaggggaccagagcattgggtgaagagaggattaaatccatctccttctttcccctcccccaaaccctcaaggaactaagggaattcttaggcattacaggattcgtaactgggtacaatgaaatagctgggtatagtgcataactgggtacagtgaaatagctcgtcccttatatcacctaataaaggagactcaggcagaaaaaactcactgtctaatttgggaaccagaggctagaaaggcctttgaccaactaaagcaagccctgcttaaggcactggcttttagtttccccatagggaagatgtttaatctttatgtgtcagaaagaaagggaatggccctgggagttctaacagaggcccacagtccagcccagcagcctgtagactacctaagtaaggaacttgatttgatagccaaaggatggctagcctgcctctgggcagttgcggcagtagccttgctggtactagaagctactaagttaaccattgggaataacgtaactgtttataccccacataatgtggaaggactgctgtcttctaaggggagtctctggctaacagactactgcttcctcaggtatcaaggtctgttattagaaggatctgcagtcaaattaagaaactgtctcttcctaaatccagccaccttcctcccagaggaagctggggagcttgaacatgactgtgaacagatagtagtacaaatctatgcagccagggagtacctcaaggaaacccccttagagaaccctcactctttatggatggaagttcttttgtagagcaagggatccataaaccagagtatgcaacagttactctgaatgatattgttgagaatgcgtctctttccttgggcacaagtgctcaactagctgagctaatcaccctgatgagggcactagatttaagcaaagggaaagcagttaacatttatactgattctaagtacactttcctagtcccccatgcccatgccgctacctggaaagagaggaacttcctcacagctaatgggtctcccattaaataccatcagggaattaatagactattatcctcagttttccttccacaggaagtggcagtaatacagtgtaaaggccaccaaaaagggatggatgaagtaggcgagggaaataggttggtggaccaagcagctaaatcagcactgagagggcctctgatttctgatacacttgaagccctactgatctgggagggccccataagagaaataaaacctcaatattctcctacagaaataaatcgggtcacctctccaggatatatccttcagccctcaggatggccacagtgttggtagaagagctgaggcaggactggcttgtccgtcataatataaaagagttttggaagatgtccagggtccagggtctaaaacccctcgtggcctttggaacaccaagctctgtgccaaagtgtggaaggctgccttgccgcaccacaaatctaagcccatggcttggatggaatccagggctcagggcataaaaccccttgtagcctccggaatgtgcacagacttgttgcttgctctcccaggcgtgaaaacatgttctccattatctcaagcagcaaagcatactgtatatgcgtcaaagaaaatgctaaaccatcagagctgtatttgatgcacccctacctttctaccccaacgtcctcacctgtttacccccacatctgcacatcctcaccacctgcttttttgtttgatcaccgataaatagtgtgggctccgagagctcagggcattcgcagcctgaataccagcgttggccccctggacccaccttatgcactcttaacttgtcttttctcattcctttgactccactggactttgtagcccccatggcctggtgtttggtctgatcaccccaacatttctggcacccaacgtggggctatgaagaccccagtgaaggaacactagagcatgcggaactggaggacgcattgtcagaggacacccgaggatgactgaaagaagctcggtgggaaagctgagcactcggaagaaacagggtaacaacaggacagaatgaaagtaaatattctgtttatttaaatttcttaaggcatttattacggagagggggagtgaaagttagtactcagaatttattaacactgtttaatacagtagagcagttttatccatagttcccagaacaagggacaatggaattagatgaatgggaaagaattggcagagatttttaaaaggcgcataaagaaggagccaaaattccagtttctgtttggtcagtgtgggcgttgataaaggcagctcttgaaccatttcaaacagatgatgaggcagattcagatgagaaagaggtagatgagtgtaaaaaattaacttcagactctgaatatgaggaacagcaaccggagaaaattaaagaaaagaaagggacgctggaaagggtatattttactagcctgtcggttccacctgctgaattaagtgaatggccacctcctccctctttccttaatgggcgagaagatgaattagctgtaaaacgtactgcttctgtagtggcaacattaaatatggggaacaattgctggtgctatacaaaattcttttcagaaggctggagctgaaggagagctagaagcatggcaatttccagttactataattcagcaaggaggacagaacattgctaattgggccacttttccttttaagatgttaaaggaatttaagcaagccattagtcaatatgagccaaattctccttttgtacaaactttactaaaaaatgtggctcttgataatagattaataccatatgactgggatactttaacaaaatctgttctcactccatctcagtacttgcagtttaaaacttggtgggctgatgaagctcaaactcaggcaagagaaaacacacaagcacagttgcctgtgcctgtttcctttgaacagttaatggggttgggccctaattggggccaattagacaatcaagcagtaatgaaaaatgtcgccattgttcagttacgcactgtgtgcttacgggcatggaaaaaaataaatgttacagggaaaaaatatccttctttcattagacctatgagagggaagtctcatttggctgaatatattaaggcttgccatggcattggaggtaacttacataaggctactcttttagctcaagctatggctgaattaaaggtggggaaaaatatgccttgtttctcaggctcttgtttaattgtgggcaatttggacacacaaaaaaaggaatgtaaaaaaaggaaatcaacaggcaagggctactaccagtaagcaacaaaaaagtcctggtatctgtccttgacgtaagaagggcaatcactgggcaaatcagtgtcattctaaagttagcaaagatgggcaacctctttcaggaaatgggaagaggggcccacctcgggcccctcaacaaactgaggcatatccagcacagtcagtgtccttacaaacgtacagcaattgtcccctgccacagcaggcagtgctgccatagatctctgcagcacaattcccatttccttacttcctggggagctatcaaagaaggtccccatgggagttaggggccctttaccctcaggaacagttggtctgttgcttggaaggtctagcttaaatttaagaggcatcactgtacatacaggaataattgattctgattatactagagagatttaattagttattagttcctcaattccatagtctgcttccccaggagaaagaattgctcagttgttactgctaccttatgcaaaactgggaagcagcacagtaaaaagaataggaggctttggtagtacaaatccagcaggaaaagctgtatattgggttaatcaagtgtctgacaaaagacctatttgtacagtaactattcaaggtaaagattttgaggggctagtagatattggagctgatgtttctattatgggtttaaatcaatggccctggcattggccaaaacaaaaggcatccattggtattgtttatagagtaaaggctgcctcagaaatttttcagagttctttaattttgccacgctaagggccagatggccaagaagggacaattcaacctattattacacctattcctgtcaatctatggtgtagagacttattacaacaatggggtgctgaaatatctatttctatggatcagtatagtaataacagtaaacaaatgatgagaaaaatgggatatctcccaggaaagggactggaaaaaatgaaagtggccaaacagaaccttcagaactaaaagggcaaacagatcgaactggattaggctatcatttttaggagtggtcattgctgagcctccggctcccattcctcttatttgattaactgccaaaccggtttgggtggagcaatggctgctgaaacaggaaaaactggaggctttaaaaaaattggtacaggaacaattgcaaaagggacacatagagcctactttctctccttggaattctcctgtgtttgttattaagaaaaaatcagggaaacggagaatgttaacagacttgagggctgttaatgctgtgattcaacccatgggcgcactgcaaccagggctgccctctccaacaatgatcccaaaatactggcctctcatagtaatagatttaaaagattgcttttttaccattcctttagcaactcaagattatgaaaaatttgcttttactgttcccactaaaaataacaaagaaccagcggacagataccattggaaaatactgccacaatgcatgttaaatagcctgactatttgtcaaacttatgtcagaaaagctattaagccagttagagaacaattcaaaaaatgctatattatccattacatggatgatattttatgtgcagctgaaactagagaagaattaatgctatgctgcaaacaattggaaaaggctgtaactgcagcgggattaatcatagcccccgataaaatccaaacttctactccctttcagtatttaggaatgaaagtagaacaaagtactattaagcctcaaaaagttcaaattagaagagatactttaaaaactctaaatgattttcaaaaattattaggagacataaattggattcgtctcactttaggcattcctacttatgctatgtctcacctcttttctaccttatgaggtgattctaaccttaatagcaaatgctctctatccaaagaagcattagagaaacttcaattaattgaaaaaaatttcaacaagcccaagtgactcgaattaaccctatgcagccattacagtttttagtttttcctactaaacattcacctacaggagttattgttcaacagaatgatctggttgagtggctttttctacctcacaatacagccaaaacgctcactctgtacttagatcaaattgctgtactagtagaacaagcaaggctgtgcacaacaaagttaatgggatataatctaaatcaaattatggttccattaaacaaacaacaaattcagcaggcttatattaattcccaggaatggcaagttaatttggcaggttttactggtgttcttggataatcattatcctaaatccaaaatattccaatttcttaagttaatatcatggatattgccctccattactcaaaaagcccctattgaaggggccattactgttttcactgatggatctagtaatagaaaaacctcatttgcaggacctcaacagcaagtttttcaaactgactttgcttctgctcaaagggctgaacttatgactgtgataacagcgttaaaaacttttaaacaaccagtaaacattgtttctgattcagcctatgtagtgcaagccatgcaaaatattgaatgtgccttaattcaaaatgtgactaatgaccaacttaatcttttatttccttctttacagcaagcagtacaacaaggcattcccctttctatatcactcatatgagagcacatactaacctccctggacctttaactaaacttaatcaaagggtggataattacatggggaagaggatttgtttgtgtttatccaggtgacaatcaggtgcctgtgtgggtgcccaccaaacatctgaagatctattatgagctacagcaggaagagaggactctgggaagagccagatataagcaatgtcacaaataaacatctcagagatgaaggagaaaaccaatctccccaaaacaatgccccctgtcagcaagaagtagctatgatcagtcatcgttcatattccaacagcagttagatgtgcctcttctgaggcagggagtgatagggacaggaggcaaggaaattctgggcagaagagggcaggtgcccagtgaaggcccgaacctgaagcctggaaccacagcccaaagtgagaacatgcattcctgttttcccgctcaaatgttgccttttccaaaaccacccatggcccgcccccacacctcatcctatgcccataaaaaacccaggttccactggcagacagcagagaagaggagaagcatctggacatcagagagtacagttggatgttggagagaagcagcttgacttcacagagacggcttgatggcattgctccaggggaagatcaccttcctgctccatcccctttccagctccccttcccactgagtgccactttcatcaacaataaaatcccctgcattcaccacccttcaatttgtgttacccggacgccaaacaagagctgaggtaccatgggagcagatgcaaaaggctgtcacactgaccctctgccctcactggtggaaagcagccacctcatgagaaaaggcagagggcccactgagctgttaacacttaagccatctgtggatggcagcactgaaagagcactgactataacattccttctggggctttgggcgtcatgggtacttctcccagatgctgccgcagggcgcatgcagttttgcccctgctgacacccaaaagcactcaccctggctcctacaactgctcacctgcgtgttccctcccacgagggttgaacacaaggggttcgggtgagtggagttttcccctgctggtgccaaagctgtgggtagctccagtgcctgtacttcagttcctgcccacgaaggggtcaggggaaatttcctgcttcaatggtagcaatattttgaggcctgcaaggtgggcaccttccccagaggctgagcatgtgcttctgccaggccctggctggagtcagtttattacacttagcagtgaaggaaataatgtacacagtggtccatttccaagacaatgtgccttgaatcagcttaggtcagcaaactacagaagaaacaagatatactaggcccctgcctgcttttcagcctccccctgccccctctcccactcccctcttagttgccctcacccaaaccaaaaaagtttagtctaaaatgaaagtttactaccctgcaaaatagtttgctttgtctgttcttatcagcctgcccagctacttaggtcataagtcaaatacttgaagagcccctgagctaactaggattgcaatgcattgtgggctgcaacagaatgcaacaagacaaccctaaagaaaacgtctaaagcccctgcccaacaaccaataggtgacatccaggaaggttgtgaccccatagtactcagcctatgaggaaccaggggagggacctgcacactaggggataaattgcttgttgaaactgtgctgggtgtgcctgctcatcaggcacccaatcttgcaagaccgtcattaaaatctcactttcgggccaggcacagtggctcacgcctgtaatcctagcactttgggaggctgaagtgggtggatcacaaggtcaggagttcgagaacagcctggccaagatggtgaaaccccatttctactaaaaatacaaaaattagccaggcgtgatggcgggcacctgtagtcccagctacttgggagactgaggcgggggaatcacttgaacctgggtggcagaggttgcagtgagcccagatggtgccactgcgctccagcctgggcgatagagtgagactccatctcaaaaaacaaaacaaaacaaaacaaaacaaagaacaaaccgtcactttcgttgttctctgggtctctgagtccattctttgggtttggacagatgagtttatttctcacatttctcacactaggaaatgtgagttccaggggagcatttgcgaagcgtgggttcactctgggtgacccagctgtgactgtgagactctttgtgcgcccagtacaatgtggaggggacttccttggggacaccccactcgggcacacaggggtttgtgttctgtttcccccagagcccatggcaatcagtgttctcatccacccactaactttcctgggctgaccccacagagtcctgcctcccttctcccgggcctggtgattatcttgccagctctccagtcttttaaaaagacacattttaaaacactgagtccaccgtatgatctggtttcagtgggaatattggtctgaccatacggaccctcccatccactcttctcccactcatgtatctgtggcccaagcccacttcctggcttattctcctaagaggctgaaatctgaagcagaaaggagctgggcccaagaaattaacttggggcatttttttaatgctgcacccaaatgctcccgtgtgaccggttattggaacctgcacagatgtgtccaggggagggcccttcccgctgccagggggatgccgccacatgtaagcaagggcaagggttccacccctccctgcacccaggaggccttccagaatcgacccagggctgcagtggggggtacagtagagaccaggagatgcaaacacgggcggggctgggtgtggaaccccaggattctggccctgagctgcagtaggcagggtggggaaagggcatggtgtgaggaccccacccaccccaggggggtccctggagggagccagtgccaggagtcctgggatacaggaggctccaccccagggaaggaggccccaaggctccctcagcacccagggcctcaggtgtgtgtgctggaaaatggggccagggtcacttttaaatattttcaatgatttccccaattattcaactggagttactaaatattcaaattgtgattacctaatgatttttaaagctttatattaatattttgaaaaagtatagactcacaggaagttaccaaaatagtagaatcctgtactctccccagacccctcaatggtgacatcttactaaggatcaaaaccaggaatctgtgctctttttatttttttattttattatttttttgatacggagtctcactgtatcacccagcctggagtgcaatggtgcaatctcggctcactgcaatgtctgcctcccaggttcaagcaattctcctgcctcagcctcccaagtagctgggattataggcgcccgtcaccacgcctggctaatttttgtatttttagtagagacgggttttcaccatgttggccaggctggtcctgaactcctgacctcaggtgatctacctgcctcagcctcccaaagtgttggattacgggcgtgagccactgcgcccagccttgtgctctttttaaatagcaccttattcaaatataattcatgcagagtgcacaatttcctggtttttatatatccatagagccgggtgtcatttttaaagaaagtcacaatggagaatgggctgagcctctctctggccaggggttccatgagtgcatggtggggtttcatggtttcctggaatggtatctggaggcctctcccctctgctgccccacggcagggctgcctgagcaccgcagatcgtgctgaagtgggtgggcagaacaggcccctcccgcaggggcgctgagtgctgtgatttgtgcggactgtgttctgagaattacttttgctatttgaaagactatttagccaatttggcacagaattccaccagatttgcatgttttaagtcatttatagcattgtatgtaacagtaacatttaatttccatgtagttctaaatatatttatgacctacttatcaaagttttttaaaaaagagatagtgtttcctgggtaacttaatttgatatagaaacagagggagcccaactcagtcagtctcataattgacataattaacatacgcacttgaaaattgagtgcaaatagtttaaaaactttctggggcctcttattggattctccttcttgggcaggtcctggctgtcaaattctgtccccagcacccccaaatctacaaagtagaagctcaagatctgcagagatgggtagaaggcctcagtaagacagctaggttgaccaacttgttccagctcacctgggatcttgccggctttgaagtggaaatcctgaggtctgagagcaccctcagttctaggcaccctcagactgttggttgtccttccggcagcatgcctgcttgactttgatgtaaacatttcttaacacacacacatgcttcttactgtcaacacactccagctaaaggccactggacccacttgtagctgagcagtttgagctcattatgcattgcagagaggaagagcagccaccacgggaagcgccagacacacgctcagaggggttagaaagaacttgtgcccacactgagccagagctgggggcttgggggagggtgcaaagaagcagaggttctctgtaatgtggatgctgtcagaactcagggtggttctgtgatcaggcatctcgacaaagctcctctgcggtgggcagagaagaatggagaacccataaagcagctgctgccactcatttttgccaacagaggggctggctgggaatttgaggggggcacactgaccttgcttttgtctgtgttcggacaaagttaagagtggccttgtcttgtctcattctgtcaccgtctcagagacacctcgtctgatattggtggtctctgaggtggctcctgtcctacaggagagtaactcagcccagctgggttgccaccagcttctggggacagggctgcaccttttttctcccccacgaagcagggaaaggtaagtagaatactgttaaaatgggccaggcacggtggctcatgcctgtaacactttcagaggctgaggtgggctgatcacttgagcccacgagttcaagaccagcctgggcaatatggtgaaactctgtctctacaaaaaatacaaaaattagccaggcatggtggtgtgcacttgcagtcccagctacttgggaggctgaggttggtggatcgtttgagcccaagaggttgaggctgcagtgagtggagattgtgccattgaactcagcatgggtggcagagtgaggccctgtcttaagaaagaaagaaagaaagaaagaaagaaagaaagaaagaaagaaagaaagaaagaatacagttaaaatgaaaacctgtgttcctcaaagtcactaatgtcaaatgacaaaatacaacaaattcagttaagattgaataggtttttatctgcaattccagacttaggcaacccctcattcttaggaaataaaaggagcatttggatgagctgagcaggagaggttggctttgtaggcaggaaaggtggaagaaagcagagacagagaccaaaaagcagattggtcatctcaaacttactttccttgtcatggttaaagcacagcggacttcccttatcacaccggctaaaactggcctatttggggatttgggggctctctctctctctatctcctgaaagagggtcagataaacaacttagtttctgcttggtggtatgaaactccccgcatgagtagctgcatttcagcttggtctgttggtcctagtgcagaagctcactccaaaccaatggcatcctctccattcatttaacaccagcaataaagtaaaaagagaggttgcacaattccaggagataccgtaatacgtgtatctgaaaaatactagtgtccagaaaacacaaagcactcctacaaatcaatcataccaaggcagagacccagtagaaaaactggcttcttaaaaatttaaatgggaatgtcaaaaaagtagacttctgaatggctcataagagtatgaaaaagtgtttgactggccaggcgcggtggctcactcctgtaatcccagcactctgggaggccgaggcggaaggatcacaaggtcaggagattgagaccatcctggctaacacagtgagaccctgtctctactaaaaatacaaaaaattagccgggcgtggtggcacacacctgtagtcccagctactcaggaggctgtggcaggagaatggcgtgaacccagaaggcagagcttgcagtgagccgagatcgtgccactgcactccagcctgggcaacagggcgagactctgtctcaaaaaaaaaaaaaagaaaaaaaaaaggaaaaatttctcagatgtatatctcaatggttcaacttttactgtatcttgcttcatacgatttattttcattgacttcagctgtttcttccctggaaaggcctggaatgctaactcttcccttcagtttttttaggtcaactcctgtaactttttttttcaagagacaggtcttgttatgttgcccaagctgatctcaaactcctggtctcaaatgatcctcccaccttggcctcccaaagtgctgggattacaggtgtgattcactgtgcccagcctcctgtaacttttttctctggttctaactctgcttttacagactgtcactaaaatgtttatctgaaaggcctaaaaaagcaatgttttcttctagtataatttaattttgtactgttggcttttcttaaggtatctaaattgttacgctaataaccttggacacattctttttgtgtttgattaaatccaagtccctttttcatcaggtttgacttccaagttatctaaattagctcctataaagaaaaacaatcatactacaaaaggtttttctttaccttttggtagctggtctaaaaccacaaaaattttatgttttatcaagataattttctatgttgtctttattaggcttgtaattacttacaaaaacctaagctttaaaagggttaaggtttttatatctatataactttctgcattgctttcaaagtcttttaattatcactctggttaaataaatatgattttacaatgcaactctgttttgatcaagtgttttgagccttttaacgtctttgacaaacttcctgaaaatcaatcctaaattcaagtctcttttgcctaaaattaactttgaaattttttagatggggccctgaaaagcctcaaaaaatctctctctcatcttatagagatactaaatgattaggctgatttggcaaattacattttttaaatgtcaaataataattcatattagatcttttagctacatagatgagtatgttaatataaatatttcaaaaaatatataactttataaaaatctaatatgctgtcagtcataattcataattctggttgttatcggttgttatcttaaagtgctatctatatgtagtagaaataattaagtatccttttcaattggaaactttcatcagatttttaaccctggtgatgtggtttgaatatatgttctggccatatctcatgttgaattgtaatccccggtgttggagggaggacccgtggaggtgtttgggtcatgggggcaggtctgtcatggcttggtgctgcctcacaatagtgagtgaattcttctgagatctggtcgttcagtgtggcagcccccgcaccctctcgctcctgctctggccacgtgagatgcctgcgtctccttcaccttccaccatgattgtcagcttcctgaggccctcactagaagctgagctgatgtcagtaccatgcttcctgtatcgcctgcagaactgtgaaccaatcgaacctcttttcttataaattacccagtctctgctatatatttctatacagcaatgcaagaacgacctaacacacatggctatgctaagtttttgtcattcactgttattattttaaactcttctctaaaaacgttcacagtcagattcatagaaaagactccaacaagtactcttaaatacggatctctaataactttaagatcgatggactaaataaaaatttctaaaactcttataaaaattaatagattcataaaactaataaaaatcaagcagaacaaaagttaatgacataaaattaaagaataaatgataaaaatgataaataataaatgataaaaatatttttataatttttatttaaaatgttattggctctttactcaaatgttttgtcttccagatttaagaaaatcttctcttttaagctatctataatttactacaatttgataaaatacatttttttaaacaaagataaaaaatttgttttttctcctcacttgattcctccaaaatgtgaaaactatacgtgagtatacttatgacaatacggttatttatataagtccaataaaatctgctctgtttataacaaaatacaatgaaaaacaccggttacattaccaagactgactaaaatggcatattttaaaatatacataaaatatctgacttcgagggtcctcagacttacagtaagttaataaaaactgtcattttctggcaggcccaagaaccttaggactatgagtaaaatctaaagtcttatttagtttgactttctagcctcaagagatttttcatctgaaattcctatatgatcaaagtaaaaagaagagttatagtccttaaaaaaaaagctataatacacctgttattagattgtaactctatgcactgtttttttagttcttatctactttagactaaatcctaaattattctaggttcctccaatccaactttcttccataaaattagcaaaatgaaaactgctctgttcctgaagcccactaagctaaaactaaactgatattacaaaacaaagtccaaggtgggaggatcccttgaagcatcacttgaagccaggagtttgagaccagcctgggcaacaaagtgagaccccttctctgcaaataataaaataaaacgaattagccaggtgctatggcatatattaatacctgtagtctcagctgcttgggaggctgaggtgggagaatcacttgagcccaggagttaggctgcagtgagctatgatcatgtcactgcactccagcctgggcaacatagcgagatctctgtctctacaaaaaataagttagctgggtgtggtggcacacgcctatagtcccagctacttcaagcctgcagtaaattaggattgcaccactgcacctccatcctgggcaacagagcaagaccctgtccctagaaaaacaaaaacaaaaacaaacagtgaccaaagtgcagcgtggagaccctctgcacccctccctacgaacatggcactgagtggcgcagtgtgggtgggctgtgggctgcagcttgagcggggccttggcacctgccatgcctcaccggctgaggccttggtggctggggatgggcacggtttgtgcgtggaacccgccctgctctcggtgcatgaattctcggggaaacgtggttggagaacaacaagaaatggtatgggaaccgtgggaatcaggcattttgcacaggaagtattgggagatgtttttactgtagtctgcctgaagctgggacaaaattgaacaaacaagatgaatttggtgctttggaaagtgtgaaagctgttcatgaactccattctcctttatcaggagaagtaactgaaattaatgaagctcttgcagaaaatacagaacttattgacaaatcttgttataaaaatgtttggccgatcaagatgacactgagtaactcttcagaactaggtgaacttggccgggcgcagtggctcacacctgtaatcccagcactttgagaggctgaggcaggtggataatctgaggttaggagtttgagaccagcctggccaacgtggcgaaaccccatctccactaaaatacaaaatttagctgggcgtggtggcagttgcctgtaatcccagctactcaggaggctgaggcaagagaatcacttgaacccaggaggcagaggttgcagtgagccaagatcatgccactgcactccagcctgggcaacaagagcaaaactgtctcaaaaaaaaaaaaaaaaaaaaaaaaaaaagaactagatgaacttatgagtgaagaagcttataaaaaatacggaaaaatctattgaggagtgaaaataacccctaaataaactagtatgaaataatttaaaatataaaaataaaaaacaaaattaataaagtaaaaaacaagtcttatgcctgatatatgaaccacaccaaaagttcaccaaattgcacgatgccgtaatcagagacaatcaaaccacaaaccaagaggagcagttgacgttttccctgctaaaaacagctgttccagcagccatggtgcctgtagtcccagctacttggaaggccgaggcgagaggagttaaacttcagcctgggcaacatgatgagacctcactatttaaaaacaaaaattgaaaaagaaacctaaaaaagcaggttttccgaagacgttgttataaggctccatataataatgagactctcaccctctcaatgccattcttcatttggcaggataatgctataattaaaatttcacaataagtaactgctataggtaacttgagaaaacctgacctaaaaaaaaaaaaaaaagaaatccttttagtccacctagtgggcaaatttggcattttccctaacacagttttttgttcaaattgtactggtggtcccttttataaacctggcgttcacaaagtagtgattaattcgatcctgtatgaaatacttctcagtggctatcacaggcctggcccagtctcctccatggccttttgtttaatttgttgcccttaggctggggctgttagttcaaaaccacttctacgaactaagtttattatattgttgccaattttttcattataatttttaaatgttgttcttagtgcctgtctaatctcaacgaagccaactctcctaacaggataatacttgctcaacacctccagataatgactaatgcctacaaagcagatgaaataaaatgtaatactggactccagatgaaactgctttgaggccaggtgcagtggttcacgcctgcaaccccagcactttgggaggctgaggcgggcagatcacctgaagtcaggagttcaagaccagcctggccgacatggtgaaaccctgtctctacaaaaaaaaaaaaaaaagagagagagagagagagaggaaaaaaatcagctgggggtggtggcgcatgcctgtaattccagctattcaggaggctgaggcagaagaatcgcatgaaaccaggaggcagaggttgcagtgagccaagatagtgccactgcactccagcctggactacaagagcaaaactacatctcaaaaaggaaagaaagaaagaaagaaaaaaagtaactgctttgagacattttttccttctggcctcgttattacacaaatgtggcccaggttgctgacttagaccccgccatgttccctccaatgtgggacagagacagctggcacaagcccattacagccccagggacagataagcctggctgcagaacggctggttagcgatgctttcagagaaatatcttgatcaaaagagaaaaatgtaaagctaatcacacaaattgggtcattcttgtcccacccaaccaagggtcaagaggccagcgggaaggagcactcagggcacatagaatttctccaagaatgtcattctctgtaagaccggctgctgaaactgctgccacctgaaaccagtttacctaatgcctactaaacaacctgctgacacgactcgttttaccctctgccctcactcatcagtcggagcttgccagctccccaaactcaccagtgccaatgagctttcttaaagagcagtagtaatatttctcctctttataaaacctccagcctttcttcattctttggacatcctaaagaccactcacgctacagatatccacaaattacacttctttccccaaataaaacattttaattttgaggattcatctctgtatttaacttcgacactgataacagggaaatacgcagcaaagacacctcaacccccaggggtccccttctaagcactccctcccccagtcagcccagacttcctaggggcggggaatggctgggcagctccacctgtgacaatggactctgccccgtccctgatcgaaatgactgacagcaagctctccttcaggcctggcctccccggagttctcacttagcaaatggctttctaatgagagcacaggaatttgtccctatgtgtggactgacaatgaataaaagaagcagaaatccatggtgaactttatttcagcgaatagaggacaaagatcagcgacagctcctgtgggattcgggagatttgtcagccacgtaggcatagaagatgggaaaatgggatccacttttttcccctttggggccaacctggcaatttgtgtgcaaagcacaggaattccacacaaggaatttggcgtaatagaagtaattagggctgggcgtgctgcctcatgcctgtaattccagcactttgggaggccaatgcaggaggattgcttgagcccaggagttgaagaccagcctgggtaccatagcaagatcctatctctaccaaaacaaaacaaaacaaaacaaattagctgggtgtagtagtgtacacctgtctaaaaaaaaaatgtaattagtaacaggaatgctccaaactcaggaaaaaaaacaaaacaatatttttaaactgctaagaagaccaaaaattatttcaaaaccatgaggtaaaatgacagaggtcctggtgaggagaggactttatcaagggtgtaatggaagacgctgggcatgattcacatgttgtggagacccctggagaaggggggctagagtcaggcaggggtgtgagtgacccaggcacagaagtggggcaggagggacttgggaccctccttctgaagctccccaggaggctcctccttttacctgcccttgatcctggagtcctctctgccagagacaggaggccacatggttctcaccaccaggctagtggacaaatccctttgtttccagggtgggcctggaagggattaggttactttctggtccacaccagaggctcccctagaaggcagacagccccagggactgactcagggacccagaggctgggatgggggaggccagggagtgaggccagggcaggcagctgtgggggctgggctggggagaggaaacagtactggggcagaggggacgcctgtaatcccagcactttgggaggccgaggtgggaggctcatttcagctgaggagttcaagaccagcctgggcaacatagcgagaacggttcctgggggaaaaaaaaaaaagaaaaaaagcatgaaatacaatgtgtctatattgaaatctgtactgtaattgagatgaaatactgtggaaaaactcaaggaatttacctaaatgctccgcaatctaattccaaataccaatggtaattctcaatacctaattaggaaaacatcacaacctgcatttgaagaaaagagtaacgttcaacttctaacgaggcgtgcgatcatttcggcacttggaacatgaaacaaagtcaaaacattttcaggcaaggtgaattgctgatcaagtatcagatgtccaggtctgctccccttaccgttgcgattgattcaccactacatctcttctgaaagtaccacacggtgtggaatcctcaacttaagtacaaaacacgacgaaactgattaggaaaatccatttgtcaactgtgggaggctctggatgtgtagagtacctagactgtggtaacccctccaccctgcgtgcctccatcacatcatccagctgttcaccttaaataaatacaatttctatccatcaattacaccgcaatagagctgggggccattttttaaaaacttcctctggcatgcagcaattgataagaacttgcaaagctgagaaggcaccgatttaaaactcgcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgcgccgcggggctgcggggtcgaggggaggggactagtgtgcaggggccaccctctccccagccccgccccccgagtccagctccgcccctgatgcgtacctggcgggactgggtcccaggggctctccgcgctccttctgggggcgccacgtccggaccttgtcccctgctgaggactacctcgcgggccgggcggggtgaagggcgctgttaagaaggacagtcccggggaatgaggggcgagggggagaacggggtcgccgggtcgggagaagatgacagacggggcagagtagaggctgcagagggtcgcccggagagcgcgggggtccccccaccagcatcccgtcgccgcttcccgtctgaccccacccgctccccgtccccgcttcccgtctgaccccacccgctccccgtcctcgcttcccgtcggaccccacccgctccccgtccccgcttcccgtcggaccccagggcaggtgggaacgaagaagtgagttgggtccccgctgtgggccctcgccctctcaagccgggccgtctccagggcttcaggttggggaacgggctcctgtggcctccagcaggctcttccactcggggcctgggtttcaactcagtcctctcccaccaccttttccatgtgtcttcaacgcccttcttcagccggggtgacccgaactgcccagagggcttgcagccttcagggacgcagtttccagtttctgggcgcccatatggacactcccctgaagcccgcctccccttcccctgggagcaggggccttgcaggttctcccaccgctcaccttgcacttgcttcctccgcctgtacagggaaaggcccacccagctcaacccaaaggcccagggccccttggtggaaaaccccaagggggacaaacaaaagacctctgcaatctggtttagagtagacaaagcttcccttaagcaagtgatctgttaggttttgtgtccccacccaaatctcgtctggaattgtaatccccataatccccacgtgtcaagggggagaccagatggaggtcattgaatcatgggggcggttttccccatgctgttctcgtgatagtgagttctcacgagatctgatggctttataaggggctcttcccattgctcagcacctctccttgctgccttgtggagaaggtcccttgctttccctttgccttccgccatgattgtaagtttcctgaggcctccccagccatgctgaactgtgagtcaattaaacctctttcccttataaattacccagtctcaggcagttctttatagcacatgaaaacggactaatacagcagttcaccacaaacccaaggcaggcttcagtctttttccgtcctgtacctagttcatttaagaacacacttagagttagaaactggatactttggccctcgttgaggatacggacatatatgtacacacatatgtacactcacacatctatggtgtaaagtggcagccatgacagtcccttcacctgacttgtctagaaatgctcagctcctgaggcagtgaccctagagggacagagagcgtgtctgggagaaatgtggaagggtcagctgcgtccagtgggcttcgtgaggcaccgcacctgccttttccaggtcgaatattccaagtggaactcaagcaagatggatctaatggggaacttgtggggagtctccgggtctgatgctggagtcgtgtccacagggtaggccacgaggaagggaacttcaggagcagctgccgccccgagaagacagactgaaacccatatcagttcctgttccttctgaccttgggtgctagggtattctacaaaagttagtttagttttgtttttgagacggggcctcaatccatcacccagactaaagttcagtgacaggatcatagctcactgcagccttgaactgctgggttcaggtgatcctcctgcctcagcctcccaagaaggtgagattacatgtgccaatgcaccctgtcagtttttgtttatttttgttcaacgcctttaatgtaatcagcctggtaatttttaaaacccttttttttttttttttttttgcagagagggggtcttgctatgttgctcaggctggtcttcaactcctgggctcaagtgatcctcctccctgggcatgcataagccaccgtgctgagcccaagccagtatttttatttagtaactcattgtttttaaataatatttatgttatatcttctatctgctaatcttacagcctgaaaatgaggttgttctggcttgctcttggcctcgagggaaggcggaccactccagagcagctggcttccattgctgtgtggccctataagcatctttcagcctgggcacttaatattgatttcttagcttgttggttccagggcctcaaaaaaaatgatgttcagtttaaatccaaacacacaagaggatggggaacctgtcacaaatcttaggggagacacttttattgtttgtcttagtgagagccctgggtagaaaaatttctttctcacctctgcttgctgatggtcgcaaaatgaattcaccttttcactgagtgtgtgtatatatatatatatatatatatatatatatatatatatatatatgtatatatgtatatatgtatatgtatatatgtatatatgtatatgtatatatgtatatatgtatatatgtatatatatatatatggcccttctaggatgcacacctgtgtggaagtcctagtctcctttacagccagagctcagggctcctgagatgaggaattcctctggggcagcagctgcatcagcgtcagtggccacgtacgtttccagcagctttgttgtttggaagatttcctttttttccccagttgcatctatgcaagaatggattttgtaatatttaattcagaatgtctagcctcaaaagatttttcaagttatctgacctactttattgttgggaaggaaataaccacttgtcttgtggtggttccatcctgtttgtctacactgttgtgccgtttgtctacactgttttgtctacactgttgtgcccattggcagaaactcctcagcatggttgtggcatttccagtgttcccagagcgggcctctgtctggtcctcccagaagtctctgcagtcactccccactgacgccagtagcagctgcttatttcccaggaatgccattccctccccatgcccagaggcactaagaccccagtttcctcccaattgggaagagacctggagggcagagggattctctctggcatagggccaaaggctcagagaggagtccaaggcttcctggcccagccaggcctgtggagtaagatgaggtcaggagatagggacagaggagcccctgggatatgggtggcacttgccgcctgcaggaagctcacgttctgacctgcagttccctgtgatgaacttcaagagggaacttactgggggaactcaccaccaatatttcaacgtaagttctttctattttccacaagtgtcagccagctgagaaacatagagggacagtacaaagagaagaattttacagctgggccgctggggatgacatcacatatcagtaggactgtgatgcccgcctgagtctcagaccagcaagtttttattgagggtttcaaaagaggagggggtgtaagaacagggagtaggtacaaagatcacatgcttctgagggaacaggacaaagggcaaaagcagaactactgatgagggtctatgttcagcggtgcacgtactgtcttgataaacatcttaaacaacagaaaacagggtgcaagagcagagaactggtctgaccacaaatttaccagggtggagtttcctaaccctagtaagcctgagggtactgcaggagaccagggtgtatctcagtccttatctcaaccgcataagacagacattcccagaatggccgtttatagatctccccccaggaactcattcctttcccagggtattaatattaatattccttgttaggaaaagaatttagtgatatcttccctacttgcatgtccatttataggctctctgcaagaagaaaaatatggctctttttgcccgaccctgcaggcagtcagaccttatgtttgtctttccttgttccctaaaaatcgctgttattatgttctttttcaaggtgcactaatttcatattgttcaaacacacatattttataatcaacttgtacagttaacacaattatcacagtggtactgaggtgacatacatcctcagcttacgaagataacaggattaagagattaaagtaaagacaggcataagaaattataaaagtattatttgggaactgataaatgtccatgaaatcctcacaatttatgttcctctgccgcggctccagctggtccctccgttcgcggtccctgacttcccgaaacaggaattcccactggggctgcctaactctggtcagtgagaccaaatctgtgatgtaggaataagaagatccatggtgcagccaccaaagttatctgctccagcccagacgtgatctgtgacaaagctggcgctttcatgtgcatgttcttgagtcccgtttgtcatgttatttctggactggttgggtcttgggcaggaggaaggaggctgtcacttactgggtctttcctctccttacattaacactacattgttccatgttatgctgtaagcttttcagctgtaaagagcctcaacaagcaattagcaaattcatttcattagaatattagaaaaataggccaggcagcctgggtatggtggctcacgactgtaatcccagcactttgggaggccaaggcagacggatcacttgaggtcaggagttcgagaccagcatggccaacatggtgaaaccccatctctaccaaaaatacaaaaattatatggacgtggtggcaggtgcctgtaatcccggctacttgggaggctgagacatgagaatcacttgagctcaggaggtggaggttgcagtgagccaagatcatgccactgcattccagcctgggtgacagagggagactctgtcttaaaaaaaaattatatatatataaaatataccagcctaaattagggtttaattcaggaagacgagcattggttcagtcactcaacagatcagatatatcaacttggctatgatgcaacaaacacattcctaaaatgcgctgggctatgcaaaattgcacaataaaaaccacaggacttacaaggaaaaaacgaggttggggaaggacactcaaaacaccccatcagtgacacaatttttttaaatgataggaacctaataaagagggtagaagggttttacatgctaaattgttgaggaatacatcaatactacaatgagcatggcactttatttgaaggcctgaagtttgcttgtggagtagatggaggaaggggtatagcctgtgagatgcccgaagcagggaacagggtcccctgggtcactggagaaaacatggtttggctctgtgttgccacccaaatctcatctcgaattgtaatccgaatgtgtcagggaagggaccgggcgagaggtgattggatcatggtggtggatttctcccttgctgctcttctgatagcgagtgagttctcatgagatctgatggtttaagagtatggcactggccaggcgcggttgctcccgcctgtaatcccagcactttgggaggccgacgcgggcagatcatgaggtcaggagtttgagaccagtctggccaatatggtgaaaccccgtctctactaaaaatacaaaaattagctgggtgtggtggtgtgcgcctatagtcccagctactcgggaggctgaggcaggagaattgcttgaaccgggaccccagaggcagaggttgcagtaagccaagatcgtgccactgcactccagcctgggctacagaaagagactctgtcccaccccactgtctctctcctgccaccatgtaagacatgccttgcttccccttcaccttcctgcatgattgtaagtttcccaagtccttcccagccatttggaactgtgagtcaattagacctcttttctttataaagtacacagtcttatgtagttctttatagcagtgtgaaactggactaatgctcaatgggtatggctcacaacccagcgggaaactgaggccactggcggattctgaggtgtgtgcacatgcactgtgtgcattcctgtgcacctcagttccactgggggtgtttctggtgttcacctggtgtttcctacagacaatcacacataagcaattgcaaaattcatgttgtgctcaaattgttccctaattgtccaaatgcattggaacgaattgacattttctttttttctttttttttttttttgagatggaatctcattctgtcacccaggctggagtacagtggcatgatctcagctcactgcaacctccacctctggggttcaagtgattcttctgcctcagcctcccaaatagctgggactacaggcgcacaccaccacactggctaatgtttatatttttaatagagatgaggtttcaccgtgttggtcaggctggtctcaaattcatgacctcgtgatccacccgcctcggcctcacaaagtgctgggattacaggtatgagccaccgcacccagccgagtttacatttcaaagcaagcactgtaatagaattgcagtcatgtaatacccaccatgtgataggcgctgtgctagacgctgcagacgcagcagcgagccatgtgcagccccaccctcgtaggagttacctggcaatgggggaagcaatcaacaaatcaataatctcatttcaggtgatgagaagtgctgtaaaggaaaaaggaacaaggcaggacagcaagggatggctttgtggtagcatttttttttttttttttttttttgtaggtctatgtatttgcttcctggggcaggcgtttacaaagtgccacagccttggtggcttcaacagaaatgattatctcccagttctgaaggccagatgtctgagatccaggtatcagtaggggtggttccttctgggagttgggaggaaagatccggtccgggcccctcccagctgcgtgtgatccgctggcagtgtctggctcctggctggtggacacgtctctgccatccctgcctccgtcttcatgtgctgttctccctgcgtgcatgtcgttgtccaaattccctgttttacaaggacgccagttatagtggatgaggggcccaacaactccagtatgacctcatcttaactaatgacatctgcaatgaccctgtttccaaataaggtcacattccgaggtactgagggctgggaactcaacgtatgaattttgaggggatatggttctacctacaacagttggtaagggaagccccctttaagtaagtgacatttgaacaagaggcccccattcctgacccctaaaccacttccaaaactaaactacttgcacaccagcctatggcccacatcatagattctgcttgtggaggggatccgaatttagagagtacagaagtggccctaaaaggcagaacctcagggcaggagagcacacaccctgcagccccactgtcaggaccctgttgctggggggagtgagcaggtgctgagcctcggcctgcaggacagctgccacggctcccagggcggatgacgatatgcacgttgggaagtgaggcctgggtccatgtggtagaggggtgctttttattttattttattatttatttatgacagagtctcactcttgtcgcccaggctggagagcagtggcacgatctcggctcactgcaacctccgcctcccagattcaagcgattctcctgtctcagcctcccgagtagctgggagtacaggcacccaccgccacgcccagctaattttttagcagagatggggtttcaccattttggccaggctggtctggaactcctgacctcaagtgatctgcttgcctcggcctcccaaagtgctgggattacaggcgtgagcctccacacccagccggggcgggggtgaggggagtactttaaaagcactgaagcaatagtcagaagaactgtggggttggcccacttaatggttttaaaggcctcaaaataataataataacaggctcaagtgagccaactatcaatgtaagacactctatgagagtccgaagccttcggggcagcatgaagagctcttagctctgcgggtacagggtggtttatgatgaaaaccaggcccaggagtattcacgactctgaataatgttcatttcatctctctcttcagccatgtttaatgtactgtctaatctattaaagacaaactatttctcacatttctgacactaaatgaggggggggatgtcccacaccaaccgatcatccaactctccgcacgccaactgggtgacctgcaattcaatttggacatgaactcctgggaggtaacccagaccctacagattaacggctcagtcccaccagaccacccccagttcagaagccaagtgcacgtctcagcctctcatttgtttgtttgtttgttttttaaaactgagtcttgctctgtcacccaggctggagtgcagtggcacgatcttggctcactgcaaccttggcctcccgggttcaagcgattcccctgcctcagcctcccgcatagctggggttacagacacctaccaccattggtcctcccatactctgaccaactggctataaatcaagggttcccacggcccctccccaggttcagtaatttgctgtagggctcacaaaactcaggggtacacttacattgaccagttcattagaaggctgcaactggacagtcagatgaagaagtacatagggtgaggtctgcaggtccctatggcaggggcttctgtccccagggagtcaggtgcaccgccctcctgacacgtggatgtgctctccaaacccctccgtttagggttttcatggagtttccattatgtacatgggcatgattaacttactgaccatcagtacttaactcaaccccagccctctcctctccctggaggtcaggtaggactgaaggttccagccctccaatcacatgggggcctcctctgcagcccccagcctgcagctacctaggggcttcagccaccagtcctcttgttaacagaaattcagctatggctgaaaggggcgtgttataaatgttaatgtaaaaactaaactctgtagaatgttttgcagggatttattctgagccaatatgagtgaccacagccaggagcaaacacaaacccaggaagctttgagtaactgtcccaaggtagtcggattacagtttggtttaacacatttcagggaggcaggagttaccggcgaagacataaatcaacacatggaaggtataggttggcacagcctggaaaggcaggatattttcaagcggtgtcagggtggggatgttataaggcacaggagcattcggagattctttaatttgcagttggctgaaggaacaaaactttgtctaaaaacagagttagcagaaaggaatgtttaaggtaagatgaggatgctgtgtcagagtcagccaccgtataccaggtcaaaaatgacctagttagcaagattgatggcctgcaggagtgacctcatccttgttttgcaagaccttcggtcctgtttgtaatttggtctgttattgcacaaacagtctgctcttcgaatcttatgatctctgttttaacattagcactagtcggttctatctaaactgcaaaagggagaggtttgaaggaggtccgtcccctcctggcaggaaactcagtttttagtttctctggggtctccttggccaagaagaggtctgttcagtcagttgaggggcttgggattttacatttagtttacgtgaatatcaaaagatgctcttctcatccctatcattcaggaaattccaagggttttagatgctcttgggtcaggagccagaatgaagaccaaatatgtgatttcttttctgggaagtatttatacactcctccctcggtatctgtaaaccattggttgcagaacctcccatagttaccaaaatccacagatgctcacgtctggtaaaagaaaaactttaggccgggcgtggtggctcatgcctgtaatcccagcattttgggaggctgaggctggcggatcacaaggtcaggagttcaacctggccaagagaccagcctggccaatatggtgaaaccctgtctctactaaaaatacaaaaattaaccgggcatggttgcgggtgcctgtaatcccagctacttgggaggctgaggcaggagaattgcttgaacccaggaggcggaggttgcagtgagccaaagattgtgccattgcactccagcctggttgacagagtgagactctgactcaaaaaagaaaagaaaagaaaagaaaaactttaggtaaattaaatttaaaaagaaaaactttaggcaaattaaatttatcagtataggctgggcacagtggctcatgcctgtaatcccagtaatttgggaggctgaggcgggtggatcacttgaggccaggagtttgagaccagcctgggcaacacagtgaaacccacagtgaaactctactaaaaatacaaaaaaaaaaacttagctgggcacagtggtgcatgcctgtaatcccagctacttgggagcctgaggcacgagactcacttgagcctgggaggctgttatctttgttttaaactataaactatgaactaagtttctcccaaagttagttcagcctacacccaggaatgaataaggatagcttggaggttggaggcaagatggagtcctttaagttggacctctttcattggctcagtcataattttgcaaaggcggtttcaatatttgcatataacctatatacatcctcctgtatgctttattttatttttcgacacagagtctcactctgttacccaggctggagtgcagtggcgcaatctcggctcactgcagcctccgcctcctgggttcaagcgactcttcaagctacttcagcctcccgagtagctaggattacaggcatgcaccaccaggcctggctaatttttgtatttttagtagagacagggtttcaccatgttggccaggctggtctcgaactcctgacctcaagtgatccacccacctcagcctcccaaagtgctgggattacaggcgtgagccaccacgcccagcccctcctgtacactttaaataacctctagattacttatggtacctaatacattgtaaatgctatggaaatacttgttatattgtttagggaataatgacaaggaaaaaaatctctgtacatgttcagcacaatttttttctacgtactttatcttttcttttcttttttttttggagacagggtgtctctctgtggcccaggctgaagtgcagtggtgtgatcacagcttactgtagcctggaacacttggactcaagcaatcctcccgtgtcagcctcctgagtagctgggactacagacatgcgccaccacacccagctaatttttaaattatttgtatagatggagttgctatgttggccaggctagaggtttttcaaatattttccatccttgattggttgaatccacaaatgtggaacccatggatatagagggtcaactagttatttttatatattatagttatatattaaaaagagaaaaaacttgactgaagagaaacccctgacttcggtggctcaggaagtttactgctcccccaccccacctaattcttctgtaaaaccttccagctcaatcttcaggaaatcccccctccccactatccccctgatgaagtggcatcgctgtctggagtaaatacccagggttcattgtctcacgccaagaagattaaggacatggacatacatgaggagtgagcttaggagcagaggtttaatcggcaaaagaaagagaaaggagagcagctctctctctctcttgcaagagagagggggctccaaaagggaaaagctggcctgcagggacagcagcagattttatagtccagcttgaggagcagtgtatgattcacgaagggcccacagattggttcaaccaggtgtgacatttacatagcatgtggggaaggctggtctccccaccctaatcttattatgcaaatgggctttccacttggccaacaccatcttgcctgcttcttactgtacacctggctggcaaagagaagggaagatacagccaacattttgatcatgcctagttccaggtagccttttcctatcggcacaactgctggcattcacccgtgcaagcttccagcttgcttgtctatgtctgcagctcgattttacaggctgccccttgttacaaaagaaaatgatttgggggcttcttttcattaaaaggaaaaccttactgagaacttctttatccttactatttgcctaaataatttctttttaaccatatatcactaccatggctttctgcagggtgtcccctattgtgctgggagggcacatgggtggtggagaaggtagaagctatcaattcttggagaggaaggtgggattcaggccacctgggggctgtggggaggggaatgaggcctaaaagatgccgaagtttgcaggaggagagcaggctaccgcccacatggggctgtttgtactctacaggactacggaggagggaagcttggaaacgtggccagtgcaggggaaagtcagatgatgtggatgttcctgggaacatccctcatctggtgactgctgggaatgctgacgtcttggaaaaatgtgctctgagtggtcttcacagtgggcaggctcagtgtacctgggcctcccaaaacgccagctctgagacccctcctgagcaaggacccctgggtggattaagcctcaagtatagatttcttatggtatcacagcatgacacctatcaataggtgttttaattatttatttttactttttatgtatttttgtttttgagacagagtctcactctgtggcccaggctggagtgcagtagtgccatctcagttcacttcaacctccatctaccgggctcaggtgactctcctacctcagcctcccaagtgagtagttgggactacagtcacaggctactatgctcagctaatttttcgttttcttctttttttgagatggagtctcactcttgttgcccaggcgggagtgcagtggtgcaatctccgctcactgcatccttgacctccagggaacaaggaatcctcccactgaagcagctggggtataaacccagggttcgttgtctcatgccaggaaaatttaggacatggacacacccaaggagtttaggaacgaggtttaacaggcagaaaagagaaagaaaagcagctctattgagagagaggggtcttccaagcagaaagaccagctgatggcagatgcgccagattttatagtccagtttgaggaggtggtgtctgatttacatatggctcacagattggtctgatcaggtgggacatttacacagcctttgggaaaggctggtcgccccaccctaatcttattatgcaaatgaactttcccctttgccgatgccatcttgtctgttccttactgtacacatggctggcaggcaagggaagatggagctgccatcttgaacatgtctatcccctagttcctgcctgcattcacccgtgcaagctcccagcttgcctgtccatgtctggagctcaactttatgggctgctcttttttagaaaatgatttggggctgcttttcattaaaaagaaaagcctaatgggggactcccataccctatctgcctaagtgatttgttcttaactcctatatcaccacctcagcctcccaagtagctgggactacaggtatgtgccactgcatccagctactttttgtatcatttaaaaaattgggccaggcacagtggctcatgcctgtaatcccagcactttgggaggctgaagcgagtatatcacttgagctcaggagttcgagaccagtctggccaacatggtgaaaccctgtctctactaaaaatacaaaatttagccagtgtggtggcacatgcctataatcccagttattcaagaggctgaggcaggagaatcgcttgaactcaggaggcagaggttgcagtgagccaagattgtgccactgcactccagcctgggtgacacagtgagactctgtctctaaataaataaataaatattgatttctagttttgttaccttgcagtctgagaaataaatcttatttctctttttagaaatcaagttgtctgttatgtccaatatactgagaaataaaaatgatatcctaagccccaagcaactgaacagacctccccatcctggtcaaggggaccccagagaaaccttgagtgccaggccatgacaggatgggaggtcagacacgcctggttctgccctctccctctctaactgccttgagggtttcttccctgagggctgaacaaaaaccactgtggttccaaccggccctgacactggccctccctttcacagttctgacaaaacaaccgatcagcattccttcctgataagagaccaccaacctcagagtgcttgtggccagtctacaaaggatgcgcagggagggttattgtgtcctctgcttcgtcttttgtcatcaggtagctgaaaactccactctcagatcaggccaacactgccattttttgtacatgcaacagacttatgaagggacatgaagctcaacttggcatgtgcatgtttctcctttcgtgaatattcacagctcctcctgtagcttattcaatatgtatattcagtcacccagctcagcatatatttctgttccctttgcccctccctcgaagtgtttgtttctggcttccacctggaggctgtgcttcccagcctattggattgccaccctgcaggatgcaacactttatgagaaataaggctgtcctttcttcatcatccttcagctgacagtataatcgagattccatattgaggatgttctatgcattatttatagaaaagtacattctgcaacagccacaagcaccactctttggggaggcaggaagttcaagctcagctagtattggggccctgccccttgagagttgtgttggactgaggaaagttcagtgataccccatgcacagggagagggaaagtgtgacagccccactctcagctcaggcagggaggtcccctgaagtcctgaggcatctgattcagcaccaggcagagggtggcagagttcactctggaagacaaccccagaacttgtggcccagcccccactgtcccacaacctgccccttcacccttgaaatcaagaactagcaagaaggctgggtgaagtgccccagcatggtggctcacgcctgtaatcacagcactttggaaggctgaggtgggagtatcacttgaggctagaagtaggagaccagcatgagcaacatagcaagaccccatctctacaaaatttaaagaatgtagctgtagtcccagctacaggctgcggttgttgtgggaatcaggagactggagagacaggtaggtgggacatgagaattttattgagtgcactcagacccagtggattaacatccaaaaactgggcccagaacaaagacagcacttgactcatatacacacctttgaacgggagtgggctagtttgaaacaagcttacagtggcatgaaagcaaggatacagagacagaacataggcagttaatcaaattgtgacaggtgcataacccagggttacatgtaattcttgctatgcagtccagatggctgttatctaggcttgcttaaaagagccttgcacaggcttatctcataaccttcgctatggggcccagaaggccgcagcccaggcctgctcaggcatgttgtataaccttcactgtgctgcttagataaaacagaatacttgaagtttctagttacagaaaacaagaatctataaattcataaaacttgcagagcaaggtacaatcacatggagggggttggggttcgagggggaactttttcttatccttatgttgagggagtgctgggagagtctccagagcacactcctttgagcctctgcttctttgatgatgttatcaagacttcgtctgggtctgggctttgtctgttactgcctttgggatgagtcagcctaatatagaaagcttatttttctctttttaaaattttattattctttctttccttaatttcctgcctcacagtgagctatgatcacaccactgcactccagcctgggtgacacagcaaggccctgtccaaaaaaaaaaaaaaaaaaaaatctgtgaagtgagaaagatgaaggcccatgggaggaagggggtggggaggccagaacctgaggaccttctttttaagtagggtggccccaagctggctttgcccggcttcccaggttcatgcccactgtcacgtgaatgggcactctctcacttccgaaggtgaccaggtttggatggtgagttttgtcatcactctgctcttaggccatggtgtgaagtcatgactttatcaagtagagagggcttaagtggaggagggatgggtgatttacattttataaagtgccccgggggctggagggagctagagtgaaggcctgggtatgagcgactccagggggacagggaggggagtacccgtcacttaggacctcagtctgaagttccctggcaggtgtccccttcacctgcccttgagcctgggggcctccctgcctggagaggccccagcaacccagccaagcctgaccttgagcaaggcctggaggctggatctgaaatggagaaattccagcatttctcaggttggccaagaagagatcaggttaccttctggtccaaagacagaaagggctccctttggaagggggagcagagccacagcctgatctagggacccagctggtggtcaggcccagtatgggtgacaggccaagcaggcctggcagttccctgggccacccttgagccaggcctgggaccaggagctggcggggctgacccggcaccaggacccccaggagcaaaggcagggcccagacaagaggagtgcaggaggtaagggacttggagcgtgccaggcctagactcccgggatccctgtctcggtggcagtgtggcaggccaggtctcactaacgcaggcctccattacaactgtcccagcactgactgagtagctagattaaacattaaaagctgatagagccagtgcccttatacaaaggctggaaagtaacaaagagcccaccgagagttttgcctaggccttccctgggccttaaagcaggacaaaataacaaattaattcttatcaggacccttttagggttaaacgagtttttttgtgggtctgaagaagctccccacgcctccagaaacaagtttattgagggtctgaaggcactccccaaacctcctgatttagcaggagacaagataaaggtaatccccccagcatctggacccatttagattcagtaaccttattgaggctccagaggaaggtcttcaggactcacagatgaccgtaagttcatcactaatgtcttcagatgcatgcacacttacacgtagacataccgcttagaaggtatgtaagttctggaaaactgtaattttgagttggtccggtgatcatttccaggcctttctccctgtaaccagttgcagaaaataaaaacgctcttcctcctcagttcatctgcatctcgtcattgggccccgagaaatagccgccccactctcagtttggtccgagaacagcgcgacagtggagttggagccgccccgggcgggattaagccgggtggaagcaagtccaggagacgcccgcccctcccccgcgccacaggactcgccagccccgccacgccctgacccctcgtctctcctcccctcccctcctcctcttttctcctctcttgccctcccccatcccctccctcctctcccctccctgcccctgcccggacagtcctggtacgccgttccctgcgctcccaggccccttccccttcctccttcccctccccttcctccctctcctcccctccccgccgcgtcccggacactgcgggctggtcccgcgccccgccagggctgccggggtgtgctgctggggagcgtgacgtgggcaggaccacgctggacacgcagttcgcgtgcggccgctccccgagcagtgcgcggcgtgggcggaggagcggctccgcgaggagatcgaggcaaacgcggcgcccgcgctgctggaaatcgtggacgcggcggacgccgagcacctggtcacgctccaggacctggacatccgccacggcgacggcttcgcggtgctccggggcgtgtgcagcgaggcctcgttcccggccgtgaggccgctgcgcgagcgcctgcgcgggctgtgggaacccggggccgtcctgctggtgctggtgggcacccaggccgaccgggactccgagcgccaggtgctgatggcgcgggcccgcgaggggccctgcccgttcccgggggtcacggccaagatccagcggaggatggaccaggtgttcacgctggcggtgcgcgagacggaggccctgatcccgcccgaggtgcctccccgccaatgcccagcacacgaggctgtcggaaaggttcattggctaatttgccacagttggttttcaatatgtccatcccttttcctgatttccagagctcagtatttctacccagtgcctatttatttatttatttatttattgagacagagtctcactctgtcgcccaggctggagtgcagtggcgcagtgtcggctcactgcaacctctgcctcccgggttcaagcgattctcctgcctcagcctcccgagtagctgggattacaggcgcctgctaccagacgcagctgatttttgtattttaagtacagctggggtttcatcatgttggtcaggctggtctcaaactcctgacctcgtgatccgcccgcctcagcctcctaaagtgctgggattacaggcgtgagccaccttgtccggccctgaagcttatagtttttaatattctataattcctgaagttttcatagtctgcctctttgcttcttatttttcaggaaacaagttagtaactgaggggaaaagcaccacgatctcccggtgcgttgtttgcaagagtgcttcagcagtcagtgtctttcttgttgtttgccagataaagatattttgtctgcatatctgcatagcttaacagtaactcaggtgctgacgtagaagtaaagcatgtgagaatgcttttggatcatacacttttcacataataacaaatttttctcgaattggtttaacagtatcgttttatgctttttaaaatgtatctttgatatgagttgtttgtcatttgcacaagttaatgattttacctccccagctgcaacatatttttcaaatttaggaacccaacttaaccatctgaacatccttcttaaaaaaaataaagaagaaagctcacaactatgcctgtgatctgaactagttgattttgttaacggaatgttatttatatagtgatggttagagaaggctctggtcatttctatttatattgtatgtgatgttttactagaaaaacaagttttaccttaacatgaaaaaaatacattttagaacctaatggcaagttcacctccgaagagggctaggcggggactgtaccctgggttttatctcttcctctccctcctaggacaggttgggggttgggatgcttacttttgaagctggaaacccggctgactcactcccctcctgacctctgtcttctggggtccctcctggcaaagcccttattcatctctctaagggggcatatcaaatgtggggaggggccagtgatgggtggggagcatcttcctggtctcagctgtcgttgtccagagctgccccctcctcctgctggagcagaggagaaacacaagtttgttcactgtctggattgggctgtgcagagaaagcccagggagaagaaacagcctcctgttcccaccaccacgacagcagagagctgggcccccatgactgcaagctgggaattcccttagcccccaccccaacagtcctgcccttctgactctccacctgcttgtgctgaggagggcctctggagaggttttgtgtccttggatcccagtccttctggatatcaggcctcgatccaagaaaacattcccaaatagccgtttctgcccttagattccctggaggaactcagacactcccactcagattcaagttttcagcttagagtgcagtgggtttctggctgactagtcaatgtcagggatggccagagccacatggccagctcctgtgaccttgctttctgagtgagcatggacgcacacaggcacacatgaaattaaagccctacatgctggattgtcctgcttttcctgtgtgtcaaatttctagactttgtatgtcacacacacattgtctcagtccctccagaggcaaggaaggctgcaagaactccaaagtgaacttgccagcatcgaatacaaccacctgtcagagcgctcggggacctggaggccccattcacagccgatggacctgtggagcaggggcaggctgacttgtgagcttgcgggtgggcaaacctcaagccctccgctgttctctcctcctggctgtgggctctgtctgctcagcaccaccaaggaacgccaggccaggaatgaaagtcaaggaggctgcgacattaatgacccacagtacgggtgagtcttctgcctctcccagttatccacagacttctgaccaatgtatttggtttctatttgtattattcagattgctgctgatactgagaactcatggggagggtttaaaattacatgtgttttccttttctgtgaaatgtatgctccttttgccagctttgaaaattttgtgaaccacattaacaacccgtctataaaataacgggggaaaaggagagaaagaagatagtttctatgtgtacacatccacataacaaggaagaaactgctcatggctgctacagtccttgtctctgaaactgatcatgaggccatggttgatttttatcacttatttatttatttatttttgagacagagtctcgctgtgtcacccaggctggaagggtgcgatctcgactccctgcaatctccacctccagggttcaagcgattctggtgcctcagcctcccaagtagctgggattacaggcgtgcgtcaccatgcctggctaatttttgtatttttagtagagacggggttttgccatgttggccaggctggtcttgaactcctcctgacctcaagtgatctacctaccttgacctcccaaagtgctgggattacaggcatgagccaccacacccggcccatagttgatttttttttttttttttttttttgagacggaatctcgttctgtcacccaggctggagtgcagtggcaccatctcagctcactgcaagctccgcctcccaggttcacgccattctcctgcctcagcctccccagtagctgggactacaggcgcccaccaccatgcccggctaatttttttgtatttttagtagagacagggtttcactgtgttagccaggatggtctcgatctcctgacctggtgttccaccctcctcagcctcccaaagtgctggaattacaggcgtgagccaccgtgcccggcccatagttgattattaaattgtgtagtataagcacacataacataaaacttaccatcttaatctttttttttttttttgagatggagcctggctctgtcgtccaggctggagtgcaatggcacgagctcggctcactgcaacctctgcctcccgggttcaagcaattctccctgcctcggtctcccgagtagctgggattacaggcatccgccaccacgcccagctaatttttgtattttttagtacagatggggtttcgccatgttggccaggctggtcttgaactcctgacttcaggtgatccgcccgcttcagcctcccaaagtgctgggattacaggtgtgagccaccgcacccggccacattgttctttttcaaggttactttggctactcgaggtcccttgagagtccatatgaattctaggatggattttctatttctgcaaaaactgccattgggctctttgataagaattgccttgaatctgtagattgctttgggtagtattgacatcttaacaatattaagcatttcaatccatgaacatgagatgtctttcatttatttgtgtcttccttagtttctttcagcaatgtttcataatttccagtgtacaagtcttttgcctcttggttaagtttattcttaggtattttattatattcaatgctattgtaaatagaattgttttcttaatttccttttcaggttgttcattgttagtgtatagaaatgcaactgatcagctgggcacggtggctcacgcctgtaatcccagcactttgggaggccgaggtgggtggatcacctgaggtcaggagtttgagaccaggctggccaacatggtgaaaccccatctctactaaaaatacaaaaattagccaggtgtggtggtggacgcctgtaatcccagctactccagaggctgaggcaggagaattgcttgaacccaggagacagaggttgcagtgagctgagattgccccactgcactccagcctgggtgacagagcgagactccatctcaaaaaaaaaaaaaatctgatttttgtgtgttgatttttgtattctgcaacttttctggatttattagttctaacaggattttttggtagcgtctttagggttttgtacatataagatcatgtcatctgtgaacagagataattttactccttcctttctgatgtggacactttttatttctttttcttgactaattgctgtggttattattttcaatatatgttgaacacaagtggcaagaatgactgaggatctttgtcctgatcctaagcttagaagaaaaactttgtctttcaccattgagtatgattgttaactatggacttttcgtatatggactccattatgttgaggtagttgcattctagtcctatcttgttaaatgtttttatcatgaaagggtatgattttttttcaaatgcatttttctgcatcaattgagatgatcatgtttcttttcccttcattcaggtaatgtggggcattatattggttgattttcttatgtcgaaccattcttgcatttcaggaataatcccacttggtcatgatgtatgatcctttgaatgggccgttgaattgtttgctagtatttgatttttagatttttcttctttcattccatgttttctttgccctcagccaggccctggttggttggggttcttcatctagtagtatgacccaaatgttcattcatgaaagatctgaactttcagtagggttctgccatttttttgttggcgttgtttgtgataaccttttactgttggaatgggagtaccaggaggtgcctcaaacaacgtactgagtcactaagtataatagtgaaacaaaccaattcccctctatcaccccttaactcccaaactcctatattctggctgtgggaaaaacaccaccatatattaatcactgaataaagattatatcaaaaccgtaagatgggggcctatccattcagggtggtatctcccaactggtgctaagataagtctttggtagcccatccaaccattctatcaggccagctgctcttgggtgattgaacaaaaagcaggatcattgaattccatggccatgagcctaatgcttcacctcttttgcaatgaaatcaattccttgatcaaagaaatgttttatgggatatgatgaaggtccacagggcattctataattctgtggatggtggtgctggcaaaagcattacacgtagagacagcaaatctatatccagaataaattccagtgaggacaaattgcttttccttccgtgatggaagggatctaatgtaatcaagtttccaccaagtggctaattattctcccaggaaatgatgccatatatcagggtctctgttattggttaaatattcaacagtgaagataaccaggtcggacttgtgaggcaaagtccatgctgaggccatgcacagcctcttccctgcctccttggtcactctgtacacaggcccattgagcaaccattctgatggctggggaaagaggctgactgcaatgcacagaaaagactgtcttgcccacctgattattgacagccccctctagaagatgcttttggatgagcattcacatgtgacaaggtaccctcaaagtctgcctatccagagaggtccgtcctttcccagaccacctcaataccaatctcccaacctgatttcttccaagtctctgatgatctagccaaaccattagcctctatactagtccataagccagtatagagccatacttctggccatcttccagtccaggcaaagtataacaaacaaatgcggcacatgaagtaatgacatgacaactgagaggactctcctttaccactgttctttttttttttttttttttttttgagacagagtctcgctctgttgcccaggctggagtacagtggtgcagtctcagctcactgcaacctctgcctcccgggttcaagtgattctcctgcctcagcctcccgagtagttgggactataggcacatgccactatgcctagctaatttttgtatttttagtagagacggggtttcaccttgttggccaggctggtttcgaactcctgacctcaggtgatctgcctgcctcggcctcacaaagtgctgggattacaggcatgcgccactgcacctggccaccactcttctttagggccaccctgagtgggactggagtgctgtagccacctacttctggaccatctctaagccaggatgagattttcccccctcaatcaactggtcataaagacctccctgtgtggacatcagtttgggttgtaggagaggagacagtgcagagtggggagggggagacgctgtctatcagtgcattttgacaactgcattcgctacatggtctaccgtcaaagccgctgaagacaagagtttggtcacatgttttcctgtggcagtgcagggctcaccagcctcccagcctgcagagatagcttcttgctgccgctgacatctgggagctggcctggcatctacatttaggccacggtgttctcctgctgaacataaataatttcacagaacgtcaacatcagacatggccactctgtgactatgacggatgaagataaaataagagcattctgcagtcatgtcgaaacatagatggaaataccaacactgtccaaaccacgtcaaatcatcgaaccttggccaacaggagtgatgactgcttctttaccaatgacaacttcagcttctctctagtctgccttccttccagataagatttattatgataggccgggtgcagtggctcacacttgtaatcccagcactttgggaggccgagacgggcagatcgtctgaggtcaggagtttgagaccagcctggccaatgtggtgataccccgccatttctactaaaaatacaaaaattagccagatgtggtggtgcatgcctgtaatcccagctactcaggaggctgaggcaggagaatctcttgaacccagggggcagaggttgcagtgagctgagatcacaccattgcactccagcctgggcgacaagagtgaaactccgtctcaaaaaaataaaaataaaaaaagatatattatgatagtcaatcatgtaacctcctgcttcctaagcatctaatccagtgcaatccctgtttcctcgagcttccttcacttcatgcaagcccaaagcgaagccctttatttttttaatttttgtgggtacatagtaggtgtatgtatttatggggcatatgggatcttttgatacgggcatacactgtataataatatcaggtaagtagggtgcccgtcacctcagcatttatcctttgtttgtgggccccccaaggtgcctgcggttccctcatgttgttgcaaatgacaggatctcattcttttctgtgcctgaatcgtgctccattgtgtacatgcaccacattttcttgatccattcatctgctgatggacgcttaggttgcctccaaatcttggctattgtgaacagtgctgcagtaaacgtgggcgtgcagacatctctttgatacactgactccttgcttttgggtatatacccagccgtgggactgctgtatcatatggtagctccatttttagttttttggggaacctccgaactgttctccatagtggctgtactaatttacgttcccacccacggtgtacgaggattcccttttctccccatcctcgccagcattcgttattgcctgtcttttgaatagaagccattttaactggggtgagatgatatctcactgtcattttgaccaaatctaagccctttctaacacctttttactgagacaccctgtggctccctgtggtgggtgctctccctccctgtgatgagcggtgaattgatcttgttcaacctggaggtctgtagctgcaggtgctggcccggccccagcctgctgcctggtgctgaggccgcttctttctggaagccaatgctgtggcagtcggggtgcaggaggcagaacccctgcagggaatttaagcagggccgatttaccagatgtaaccgggacttacaaagctaccggaagggttggaggagtcggttctgggcctagcctctgagcataacttccagaatcaattcgttaagccggtcccaactccagaggggactgtaggcaatgtggggggactgcatgcaaaggatacagacatatatatacacacatatgtacactcacacatctatggggtaaagtggcagccatgacagtcccttcacctgacttgtctagaaatgctcagcttctgaggcagtgaccctagagggacagagtgcatctgggagaaatgtggaagggtcagctgagtccagtgggctcacatggagaaagatcaggatctgtgacttcagggaaacgggacggggttcgggggctaggggaggtgggcctgggtcccgtgagcacaggtgggtccaggggtgggtgtgggaggaggcgggctgtggaggaatagctcacgcagggagttggtgcattttccccagtcgaggtctgacatactgagaggccgagacccaggccagcaagggagcccgggacactgccggtcccatgggaatccccagccttttccctgacagcccaatgccctgtcagagaacagcagggcaggggacagctttgggacaaagattcactattgaggcgtggatgtgtctccaccccccaccccctcccctctccgacagcagcaggcctggagcctccagggccacttgggaaggcaggactacagggagaggtgagaaaatcagcttttttcccctcacacaccccttctggcactgaagaaggtcgtcactggaggtgtaaggtgacaccaccatgcaggagaggggaggccttcacccaggttgcagtgcaaaggtgcaatcacagctcgctgaagcctcaagctcctgggctcaggcggtcctcccacctcagcctcctgagtagatgggactacaggtgctcactaccgtgcctgggtaatttttttttttttttttagtttttgtaaaggtgggagtcttgctgtcttagccaagctggtctcgaactcctggcctcaagtgattctccagcctcagcctcccaaaatgctgggattataggtgtgagccactgcgactggcctgcgctgcacttttgaaagctccaaaggcttacaggtgtaaacgttgaggtttgtggtagacagtctgcagaaatgaccaccagctattccccctgcacacaaaagctgcagctcccataaggaggtgagtctatttcccgtcccttagaatcggacctggctgttgacttcctttgaataatagaatgcgatattgtgtcagctccaagccaaacctttaaaaggactgacagtctcctcttttgtcctcttgcaactcatccaccacataaataagctcaaagctagactcctggatgacaagagaggatgcaaagagaaagagagagtttcctagccccaagctaatccagccatccctgatgaggcagcagctgtgtgagtgaacgcatggatattccatccccagctgggctcctagctgaatgtagggcatgtgtggcctaagccaaaaccatgtaaaccagaagaaccatccagctaagcccagccaacactcagattcataagaaataataaatcttttaaatttaagactgctaagccttgggttcattatatagcaacaaataatcaatacagagtccacagctcaccaagattaggaatccaggtaaaacatctgctgctgtgggctgggatctcaaaagttgcatcctggaagtgaaggtaaactaagtaaatcagccttcagagagactgaaacccacttttagggagatttttcaggaaaatctcaagccctgaaattagattaaggtgctcttttattgttagtgcttccaggcatctggatgaaaccattgaaattcttctggaggaagagaataacccaagtttcaagttatttctacagaggatttatctagtatataataaaagataaacaggtccatactgaataagatttaaaaaaaaaaaaaatccaagcaacaacaaaaccaaacagataacaacagacccatagagacccaagatactggtttaataagacacaacagctttaaaactgctatgcttaattgataaatgaactgtagattaaacacaggtgaagagaaatatcaatgaactgagagatataagatacattattcagaacagaccaaaaaagtaataaatagagaagagggagaagagacaaaggtaggggagtctcacataggtggaatttgaggcccccagaaggacagaaactggaccagagcaaaacatttgaaaagcaaatggctgcaaatttttaaaaatgaatgtggccgggcacactggctcacgcttataatcccagcactttgggaggctgaggtgggtggatcacttgaggtcgggagttcaagaccagccttgccaacctggtgaatccccacctctactaaaaatacaaaaattagccaggtatggtggcgcgtgcctgtaatcccagctactcgggaggctgaagcaggagaatcacttgaacccgggagctggaggctacagtgagccgagatggcaccactgcactccagcctaggtgacagggccagactctaataaataaataaataaaaaataagggccaaataaagacacttgcagcacaaaggagtttgtcactaacatttacactaaagcaaattgtaaaggaggtgttttaagcaaaaggaatcaggaactgacatggatttctgtctgtcttgctggggctgcagctgctcctgaatttcccttcttcattacctgcccccgtggacattccactccagcatcagagacggagactcttgcttgagttccacttagtagacacgacccggacaaagcagttgcagtgtctcagggagcccactggacgcagctgacccttccacatttctcccagatgcagtctctgtccctctagggtcactgcctcaggagctgagcatttctagacaagtcaggtgaagagacagtcatggctgccactttacaccatagatgcgtgagtgtacatatgtgtgtatatatatgtccgtatcctcaacgagggccaaagtatccagtttttttctttttttttttttttgagacagggaccttgctttctcacccaggctagagtgcagtggcacaattatggctcacaagagccccaacctcctgggcttaagcgatcctcctgtctcagcctccctagtaactgggactacaggtgtgcaccagcaggagctgattgtgtgtgtgtgtgtgtgtgtgtgtgtgtgtgtgtgtgtgtgtgtgtgtgtagaggtagggtctcactatgttctccaggctggtctcaaactcctgggttcaaacaatcctccctccttggcttccccaagtgctgggattacaggcctgagccacttcacccaactacagtatccagtgtctaagtttgttcttaaatgagctatgtgctggagggaaaaagaggagctttgtctactctaaaccagatcgtagaggtcttttgtttgtcgcccttggggtttttcaccaagatgccctgggcctttgggatgagccggatgggcctttcccggacaggcggaggaagaaagttcaaggtgagcagtgggagaaactgcaggccccctgctcccaggggaaggggaggtggccttcaggggagagtccatatgggcgcccagaaactggaaactgcgtccctgaaggctgcaagccctctggacagacagggtcacccccgagtgaagaggggctttgaagacacatggaaaaggtggtgagtggggactgagttgaaacccaggccctaagtggaagagcctgcagttcctagggtgccttccttcttccagtcaattcatcaatcaatccacaccaagtcagtgcctaccccagggcagacacttgcgaggcccgaggtcaggaggccacaggagccccttccccaacctgaagccctggagatggcctggctggaggggacgacggcccgcagcggggacccgactcacttcttcgtccccacctgccctggggtccgaagggagccgcgtgggaagcggggacggggagcgtgtggagggacccccgcgctcccgggccgaccctctgcggcctctgctctgcgcagtccgtcctcttctcccgacctggcgtgcgtctcctgttccccggccccccatcccatgggaccgtccttcctaacggcacttcaccccgcccggcccacgaggtggtcccgggccggtgacaagatctggacgtggcgactccgggaaggggcgaccgggcgcggagagcccctgggacccaggcctcagggacgcatcggggtcggagctgggcccgggggcggggctggggtggggaggctgaggttccttcgccccttccctcccctcgccccccgcagcctcgcggcgcgtttcctgccccgcccgccaggagggagtggcccccgccaagtcccgcgcgtctctgccaagaccccgtgcgggtccgtgccggtcgcgctatccaggcgcccgcccaggcttggggagctctgcgcgcgggagccggcgactcctcggggcaccagggcgtggcgagggcgtcggcctcggcggggaggccttggctgggccgtcggggtggcgccgtgccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagctttgcaagttcttatcaatcgttacatgcaagaggtagtttttaaaaaatggttccccagctttattgcggtgtaattgatggatataaattgtatttattaagggtgtacagctggacgatgggatggagcacacagggtggaggggttaccacagtcctgtttccgtcgtggttttacttaaattcagcgttacctatgtggtgtccctggacactcccagcagcgagagtcctggtggatggcatctctttcccttctaaccatggccggggccctgggtgacgtcccttctaaccatggccggggccctgggtgacgtcccttctaactaggtccggggccctgggtgatgtcccttctaactaggtccggggccctgggtgatgtcccttctgaccacggacgggggcctgggtgatgtctcttctaaccatggccaggggcctgggcgatgtccctttgggcttcgtttgcatttccctgctgactgaagacggcttttgtgcaggtcctatttttttctgtctttccgtgtggaaattgtgaagaccacccaaatgaggaccacgggcctcttaattcagggcctgtggagcagcggcctgggcccctcccttgggtgtggcagaggccagcaggcgggcaggtgggagggctttagaagggaaaccgggaggctcaggcaggctccgatagaggtggggggctgggtgaggggcctcccaggtgctgtgcttggggaacttggtctgctttcctggtttgtgtaatttggtcccaccgaggcaggccacagactgggggggtgtcatccttgcccaagccctgaccaccccgcagtagcagctggaagggtgtgctgggagactccggtctccagctctggctgttgtccctttctagactcagcctctcctttgtgtctctagaggcgggaatttttgctatttttccatgtgtttcattgagccacagtcacctgttttgacattgtccctgaatgtgaccagcagagccttggagtgaattctggctccctctaacctgccctcctgagtctccgggcaccgccccggcttctgggcaacgcagcagccccagctcctttgtgactttcccccaagaccgtgcagcgggaagggtcttcggaaaccagccactgcaggcggctgtgcttggcatacccgagggcttgaggcttctaggccatgcagtggacagagttggaaagtacagacttgttttggtatgtcagtgttaggttttcattaggaatggcattataaactttttttttaatatgtagaggcaggccaggtgcagtggctcaggcctgtaacttcagcacattgggagcctgaggcaggaggatagattgagcccaggagtctgagaccagcctgagcaacatagagagaccccgtctctgcaaaaaataaacttagcccagtgtggtgatgcatgcctgtagtcccagctacttgggaggctgaggtggggcaggagggatgtgggggaatcccttgagcctaggaggttgagtgtcaaggccacagtgagttgtgaccactgcacttcagcctgggccacaggaggagtccctgtgtccaaaagaaaaagaaaagaaaagaaaagaaaagaaatggggttcttgctatgttacccaggctgggctggaggaatcctcccacctcggactcccaaagtgctgggactataggtgtgatcctcgcctgaccgaaatctaacatttttacttctttcatagttctattaccttatttgctgacaacttcgagtcgtagtatttttgtctatcttatatccctgagtttcagatttgtgtcaaaattattaaatcaactctgaaatgacctttataatttgcagttctttgtgccttggaatatatctaagaatggttagaacagcaaatgttatagacaggtaaatagaacaacagaagagggtagatagaagatgccaccactggtcccgttatttcccacagtattagagctccttgcaaaaactgtggtgtagggattgaagcgggagggaaaaaaaatcccatttttttggaagataatcttacagaccgaaaaaacaaaacccaccggacaaacctttagagagaacagttcatctttttcctttactaggctgagcagcagcttgcccctgccaatctagaaacttccatccttcaagaatgggaaatctcaggctgggcccggtggctcatgcctgtaatccaaacactttgggaggccgaggtgggtggattgcctgagctcaggagtttaagaccagtcggggcaacatggtgaaaccccgtctctactaaaaatacaaaaaaaaaaaaattagcctagcttggtggtgcatgcctgtaatcccagctacttggaagcctgaggcatgagaatcgcttgaacccgggaggtggagggagacttcagtgagctgagatcacgccactgcattccagcctgggtggcagagcgagactctgcctcaaaaaaaaaaaattagctgggcgtggtggcacatgcctgtaatcccagctactcgggaggctaaggcaggagaattgcttgaactcgggaggcggaagttgcaggaaggaagtgcaatgagacgagattatgccattgcactccagcctgggcaacaagagcgaaactctatctcaaaaaaaaaaaaaagaagaagaaaagaaaagaaatctctccagatgcatttgttcctagtagtctgcatccatttccttcaggagacaaggtggttgattgaaacacagaggactccgtgccctcagagctgaacccgggaatggcaccacgctcggagcggtgatctgggcacctgtgctccagcccgtagcagtgatgagcaacagaggagggaccagttgcccacccaggatccacctccacctgcagtgcttgcacccaaaccacaggggcccccgctgtctgggatgcccccaccctccaggctgcggctccagactgcagaggagagcccggccaggctcccgggagaacctcgggccgcatctccacacaggacacaaagtctttgtccctccatcctcagagcaagggggacagctggtttactctccacgagcttagttaggagttaagcagatttcatgaaggcaccgtgataatattaccaatgctcatggcttggggtaattgtgtcaaggccaatttaacagtatttgccgcagaatcatccttaactttcaggctgtgaattggctgttgatctacataacaatctgagaacttggtgaggtgttttgggattctgatgggcctgtcggaacacagaaccatttttgaaatattttattttatccagtttctacaagtagaacttttaaaccatggatttaagattaagaagaggctgactgcaagctcataacaaatagaacatcgaggctgggcagggtggctcacatccataatcccagcactttgggaggcagaggcgggaagattcctcgagtccaggagttcgagagcagcctgggcaacatggcgaaaccccagctctaccaaaaaaaaaaaaaggaaaaattagccaggcgtggtggagctgcagtgggaggatcacttgagcccaggaggcagaagatacagggagccaagatggcaccactgcactccagccctggggacagagtaagaccctgtctccaaaacaaaaaacaaaagaaccaaaacaaacaaaacacccacagaggatcctcccgccccccaagcccaaatagaacattgaagtcagcgtgaggtctctgcgtttggtctgcttagtggcttagtctgatgaggctgttcttagttctgtcgttcagaactatgtctgggctaagaatccaggaaggcgtggcttggtccactgcgtcccttcgtggtgatgggggcagaagacctgggcagcctgtgtcccgagcccactccccacatctcagtggctgaggacagagtccttggagggtccttgcgtatttcctgttgaaagattccacttccgatctgtagcttgaagtgcaggtcctcaaggtaagctcgagggaaaagcagaaaccacctgttgatgatgggcacccgagtcatgagttacagtcagagcccccaacgttggcagggacgaggacgggcctggagacacagcgtcagcctcagcgcttcctcagcgacgcccctgggaggggacgctggaagaactggcaggtcactagattctcccacagagctggtttcatcatcaccaggtgataggcacgttaaacccagaactgttaactgttaactaactataactgttaaataataccaggcttgtctctgaacagcagcgagagtgcacttcctctgaggggcacacgagagtgagacccgcacatcctgtgttgcttgaccgtcgggactgaccagggacagaggacacttaactggccaaattccctccttgccatcagccacggggcagttccccaaagcgctaaagcctggagaacgcaaagcacatccagttacttaaaagcagcctttgtttcctacaatgagagaataaatccttgatgtagtccagtggccacccgggagttcccagaaagacactggcctcgaagaactgtttctgtctgtttgccttgaatatgggacagacaagatcagagcagcgatgacgagagaatcgcgcacaacacttagagtctggggccgaggaatggctctgtttactcttaactataaataaatacacacacaagtacgcacttggctttttcaaagtaagacttaaaaggactcaagaatgtaacaaaggacaaatatcttccctgttttctaagaaaccagcttcaagatctgtcatagtaacggatataaaagataaaactcgctttttattttctcccagtgggcttggtagctcatacctgtaatctgagcactttgggaggccaaggcagtggatcatttgaggccaggagttcaagaccatcctggccaacatggcaaaaccccatctgtactaaaaatacaaaaattagctgggcgtggtggcaggcgcctgtagcctcagctacttgggaggctgaggcaggaaaatcattagaaccagggagacagaagttgcagtgagccgagatcctgtcactgcactccagcctgggtgacagggtgagactctgtcccaaaacaaaacaaaacaacactagctttgtgttttctgtcgaagaaaatattttgctctgagggattcatgagcctgagacatctcaaacccatccacactgagcagcctgtgtgatgttaattaacactgttttttttgctcttgtcaaacttctttgcaggaactgaagaccccggcagacacatgtcacttcccctcagaattgctgcccggctgagctcccggaaccctggacctgtcctctcttcctcttcactcaggcccagccttgaggacgagcttcttctcttttggttattcccagagcacgcttgttatcacacaaacaccattttcagttgctccatctcttcaaaaataagactctcctgacaacacagtacactgaacaaccctgaatgtcctgtgcggccacggccactcagccctacctggggaggcagggccctgccagggggtgacccagagtttcctgctcttgggtcgtccaggaggcgtctgaagaatgttcttaggctgctagttacacatcagtccaaagcctcagggatgatgaggattttgaagctattcaggcacctgaggctgggctaagactcccactgtcacctgtacctacttccctgtcaccaggagggcctggctctgtcccacgcacacctggtctgcacactcacctgcaggcctgagctccacccggggctgctccactccagcccgaaagcctccctaatgagggaggttgttcagtctcacctggggcttgggggtgaccaggtggaaggttattgggggcatctgcgcacctggtgagatgggtacgtgttctccctgagagcacagctcatgagcagccaggcgattcaggagcagacctgtgtcagatgggatttcaggccactccggagagaaagtcacccctgccctcgccatcatatacacacactcccctcgccctgggcagcctctcagctgctggtccagagcccccagggctgcagcagtgacacctcctgcagggccagcctgagttgaggcaggatctggggcctcccccagagctcgacccagcccacccctgcaggagaggcccccgtggggctggagccatgtgaagggcctgctccctggagacctcagagtgtccagaggaaacaaaactacacataggactcccagaggatccggcagtcccagcaccgagcattatcaaaggaaacgagtcagcacacagggacgcctgcatgcgtgttcactgcagcgctgctcggttgctgaaatccgcctaaataggcgtcaactggagaatggataaggagcgtggtgcacacgatgcaggaccattcagccatcaagagaagggaatcctctcatgcagccacatggatggagctggaggtcatgacgtgaagtgaaatcagccaggcacagaaagacaaagcgcatgtcctcatactcacagggagctaacgtggctctcagggaggtagagagtggggtgatggttgatactgacacgaggctgggagggcatgtgggtgggaggggagcggatggagaggatgcttaatggtacacacacaggtacagggaaaggcctcacattaactgctgtcaccgactctgccatggaacaactatatttactgtattctccaaaatagccaaaagagaagatttgcagtgttcccaccacgtagggatgatgagtgctccaggtgagggatgtcctgaacattcccacttgatcactacacatttgatgcgcgtaacagaatgtcatgggtgccccataggtctatatacctatcaatgataaaaaggaaaaagtgccctgggacccaggcagccaatgactcagtgctgggccttgatcacagccaccacctggagggcattggccacaggggcctgatgggcttggctgatgcaaaggttgtgctctggtccccaaacctccccctgagcagagcaggccggccagggtcaccccacctctcacatgagaaggagttgttgatatggaggcagccccaggcagagggcagacaccgctgggagggccggacccctgccctgaagtgcagcctttgcagggatgagcgggaccctcacagacaggcgaaccagagctgcaggaacagaggcctggacatcaaggagccagaactggacaacagggactcagcaggggcccaggagacagaatgggcaaacagaaggaacaaaggaggggaggagtctgcactaagggtgctggggagagtttgggacagagggagccacaagatcgaagacttcctggaggaggtggcacccatcacagggaggccagaggagcagaaggggcaaaggacagacaggaggctgggaatggatcccaagggagtgagccacaggcaggccccagcaccagtgaggtctgattgcaggagccactgcaggagtcaggagagagacgaggcccggctgaggcaggaggatgcaggggagggggtgggagggagggaagagcctggaggaggcagcgtccactggggacagtgaccaggaggcaggcccagggaaggtccctctcattcatgagggtttcaggccaggagaccctacctccctaagctccacatgaagctgggtctgacacagcccctcccctagcaggcagggggcaaggggacagcggggtccctgtccagaagtcacccaggcctactgctagctggacttgaggcctctgtgtccccagcaggcagacatgtgcttgggtcggggtggagcctgcctgagcagatatccccagcctactccatccttctgggcctcccgaggccacaggagacacgacaggtaccaagtccagggatgggaggagtttgggacccagcactgccccaggttgtggccctgagcaagacatcagggctctgagcctcagtggccctccctggggtcaagcaactctcatctgcttgggcccaagtcccactgtggtgcccacagccctccaagggacagtgtcttccaagggacagtgtcttccaagggacagaggggcagggaatacagggtccactcctctccctcccttcctcctgccccacaccctacctgggcggccacagccgccctgtctcaggcccacagtccacacaggacccccttctctcatctgcccaaggtgaccagaccccaggaacagggtcacctctgcctactcctaagagcacctcaggtccccaagcagggccagggtgcacctgctctccatccctggcacacaggccctggcctgcacacacaggtggtccccagctctgtcccttcaggttcattacaggggaccctaatcctctaggccagcagtgggggtgttgccatgcccccaacccagcaagaaatgtgagaccaggacaggccatccggtccctgggtagagggcctgcctggatggccttccctcccgcacctgccccactgctgactcacctggaaggatccagaagcattggtgggagggcctggggcccccaggagttggagggaaggggcccaagagagtgcccggagttgttagacttaagtgcttagcgtttgtggaggggatgggacagggccctaacagggaggggtggggggaacttctagagggtacaggggcagcagggccaggcggccccgtgggcagggacataagactaaattgctacaagtcaaaatgcgaccagtcaaccctggacaagtccttgctcaaaatgctgagtgtttgtgagagagaggagggggaatgaggtcctatggggaggggaggagggggggaccttctagagggcacagggcgggatggccgggcggcctcatgtgcagggacctggcatatagaaggctgccatgagttgcaggactgactagggattaaccctagacagggcccggatggaacaagtgacgagcatctctgaggtcagaggtggggagggctgcaggcctggggtccactaggtcctggggcacaggggaggatggaggcccggggtccctgaggcctctcctgcagatgccgtggagtggccggccctgtagaccaaaaggtgttgtggatggtcatggagcggagaggggtgatgagatccctgggtgcaagcaggtcaggacaggggaggcggagccaggtctgtgcccacaatgggggttcctggagccgctgctgggagcaagtcccccttactgagtctacctgccatgacagatggggatactgaggctcagagagaggcagatgtttgctgagggtcacagccatcaggaaggggcaggagccatggagggtacaggaaggaaggagagaggtggggagagcctcacgggagaccacaaggactctgctgccaccatagcccagagccagcccctgtcccaggaggacaactgtgctatgggccagccccaggggagtctgtgtcccccaggcagagctccagaatcttggagccacctggctggcctgagccccaggtcacagccacagccaaggtcatcccatatcttcccttcaccaggactgaggaccgcgatccctgctggaggggccctggctgcggtaggctccctggcaggggtctggacacatcagacattcttcacacacctgaggtccccggagggaaagaccaagccccagacccgtcctctctcctgacctgacccaggggaggggcaaccgagatccctgcagggagggacagcacagacctggagcagacaggggagctgggaactagcgaggggcccctgggcaggtcccccaggagggccagagaggggcagtaatcagaggaagacggctgcgatggaaccaggctcagagagagcacctgagagcaggcagcgcctctgcccacccggcccggggatgacggcgcaggacagacacctggggggctccagctgtgatccagatccagacctggacggcccaggaggatggaggcagagcccgggcccacagatctgcagactcaggcacctgcagggcaagtcctcagaagatgaacagtcccctgtcccagacacacattgtcctggacaccaaagcgggacccccagatacaggagtggaccaggaagcgtcccaggaactgccctgtgctcgggccctggactgagaccacaggggtccaggcggtgcgaggtgggagagactgaggagtcccgggtccttgagcgaggagacgggcgccgtgtcaagaaaacagccccccaaacccctggccctggcccaggcgtgggaagcatccgagagtcatcagggagagtttccgaccgcccaggataccaggatgcagttggctcaggtgggagcagacagggcttcttgcctcagccaggtgaggctcaggtgggccaaaggagagggcccaggaagtagggggacagcaggggctctcccaacacagagccgcgatctcaccccagcaggacgcaggtgccagtgcaggaggggtgggcatcaggacgtcagaaaactcgccgggggcataggtcacgggaggtcattcacacaagcaaggcacagaagattctagtgcaaaccacaccacagccaagcacccacccctggcagaggaacctctggggtggaagagcttgtcccccactccagcagggagcagcccctccactcccgggagctccctgcctccaggtacagcccctgccactgctccctgggctgcggtgtgctcagcacctggccctgccctcttggagcagatggcacccagagcctattcagacaccccgggtcccctctccctctactgggctcagggcccagagaagggagaaaccagggtgcggattgagggactccaccttgggcctggagcaaaacaggacaaagagccctggggtggcagaaatgggctggggaggaggcctctgggccagggaggggctctgcctcccacgtgctgggttttctgggagcctcccagggcaggaggccaaggcctaggcctgctttaacatttgaggggggcaggctccttggcctgggtctccgcagtgcatttgggcagcaagaccaagagtggcaaccaccaaggcaccgtcagggagcccagccaggctctggggcttcgctccttatccccctcccccggccaggattaggcgctgccaggctcacctgccggcctgagtgagtccagccgagagggctgggaggccggagggcagggctgggaggcaggaggctggggttaggaggctggagagtggggctgggcagcagaagggtggggctgggaggcaggagggtggggctgggagggtggcgggtggggctgggcagcaggagggcagggctgggcagcaggagggcagggctgggaaggcagccagctccagggccccctgcctgtgccaggcccagtgggagcagcagggggatgggcagcccctcccataggtgccagggcttggtgaggctggggcagatggggaccatcccggcacaggccatcccccaggcccctcccttcaggcgccttcactccttctgaacctgaagcctcccgcaacaccagcctcctaaaatcttgcttccgggggccacactcagagactccatatccctccccactgaccggacctcaggtgctgacccctggggaccgggtcccccggatcagaaggcactgaggcgcggagtgtggcaggaaccgctgaggttcccctactgtcagcatcacagctgggcccctggattgagcacagtgggtgtcctggccctgtgcccagcctgcccagagcctcccctttcctcctcacctgcaccccctggagcagcaatatcaccactcacattactcagaggagaggagccgaggccgagaggctgaggacctgtctcgggtctcaagttcggagctggcagccaatgccccagcgcccccagcagcccggcccactctctccagactccctgcccggtagaagagcacatggggccagctcccctttgcggttccaggaggctcctgtggtgcatacttgctcaaagtgacctcacaagctcagtctgatgcagtaatcccactgctaggaagatagtgctttaggtaaaatcttttggttgcctgtgctagacaatccaactttaaaaggtctttggagaaagaagacatagtggggcatcttagtggtgcgtttagatgaacatcccaggacagcttcaggtagggctggatccagggccctaccacattcaccagatccccagtgccgtcattctaggggctgctgtgctgacaagctgtctgtgtgcagctccagcaagaggatgcctctgtcatgcaggcctccctgatcctgtctaaccttcgctgtggctcttgggaacccaaggtcctgccagggcagactctttcctttccctcaaagtgtcctgtgtcctgggtgaggctgaggtgctgcctttactaacaggctctcagggacgtggatgtctctgatcctgaagtaacaaggctctgccacccccaggggcctgtgacccaggcctggccatgttaaatgtttgtctaatcatggaatggaactgatgtctcaggtgaactgaaggatgatataaaatgacgggaatctctttttccttccaggataactgatgctttcagtaggaggtcctctccctactctctttttctctatacattctgttgggaacaggccccccaaaatctggccataaactggccccaaaactctccataaacaaaatctctgcagcactgtgacaggttcatgatggccatgacgcccacgctggaaggttgtgggtttactggaatgagggcaaggaacacctggcccacccagggcggaaaaccgctcaaaggccttcttaaaccacaagcaatagcatgagtgatctgtgccttaaggacatgctcctgctgcagataactagcccaacccatccctttatttgggcccatcccttcatttcccataagggatacttttagttaatctaacatctgtagaaacaatgctaatgactggcttgctgttgataaatacgtgggtaaatctctgttcgaggctctcagctctgaaggctgtgagacccctgatttcccacttcacacctctatatttctgtgtgtgtgtctttaattcctctagcgctgctgggttagggtgtccctgaccgagctggtctcggcaagtggcgtccattcgtgggggctcgaatccaggtcaaagggtcgccggagcgatggttggagaacgtggaactaagctggaggacaccaagtactcttaaagcagtccccgtggtgagtaagaaggggagctcagaagcatcagggtaacaatggggcaggtgtggggtgtggttcgttccactgtggaacttcttcacactggtaatgaggaggaaggagagtataatgaagtaacagaagagtttacagagtaggtttatttgccagctaaagctaaagcggcaaaggagggagaggttcatccctacccttctgcaccccctccttattattttgaagaaaaagaccctccagatctttcttttccagaggacactgggcgaaaagtagttgccccagtgacagtttgagcagcgcctcgagcgaccgctcttagttctattcaggcaggaattcagcaagctagatgagagggtgatttagaggcttggcagttccgttacaatacacccccggatcaacagggaaatattatagctacatttgagccttttccttttaaattactcaaagattttaaacaagctataaatcagtatggaccaggttctccttttgtaatgggactgttaaagaatgttgctgtttccagtcagatgattcctactgactgggacgctcttactcgagcttgtctgactcctgctcagttcttacagtttaaaacttggtgggcagatgaagcttccattcaggctgctcacaatgcccaggcccaacctcgaattaatataactgcagaccagcttttgggggttggcggctgggctggtttagatgcccaagtggtcaggcaggatgatgccatagaacagcttaggggagtgtgcattagagctgggggaaaaaatcacttcaagcggagaacaatacccttcctttagtgcagtaaaacagggacccaaagaaccatatgttgattttatagctcggttacaggagtctcttaaaaaggtgactgcagattcggctgctcaggagatagtgctgcagttattagcttttgacaatgctaatcccgattgccaggctgctctgcgacctattagagggaaagcacatttagttgattatatcaaggcctgtgatgctatcagaggtaatctgcataaagctactttgttggcacaggcaatggcaggattgagagtggagaaaggaaatgctccatttcctggagcttgttttaactgtgggaagcatgttctgttgggtcatactaaaaaatagtgtagaaaaaagtcagcgagtcaggctgccagatagggaagaaagaaaactgctgagcctgaaatacgtccaaaatataaaaaaggaaaacactgggctaatcggtgtcactctaagtttgataaagataggaacccgattttgggaaacaccatgaggggcctgtcccgggccccattccaaaccggggcatttccagctcaggccattccctcaaccctgtacaatgtctgtcccccgccacagccggtagtgccgcagtagatttatgctgcacaaaagctgtgaggcttctgcctggggaacccccgcaaaaggtcccaacaggagtctgtggacccttgccagcggggacaataggattagttttaggaaggtctagtttaagtttaaaaggggacaaatacatacaggagtcattgattcaggttacgatggggaaattcaaactgttatatctacttctgttccctggaaaccagagccaggagagcgcatagcacggctcctgatcgtgccatatgtgggaatgggaaaaagtgaaattaaataaacaggaggatttggaagcacaaataaacaaggcaaagcagcttattgggtgaatcaaattactgataaacatcctacctgtgaaataactattcagggaaagaaatttaaaggtttgatagatacatgagcggatgtttccatcatttatctacagcactggccgtcgacgtggccaattcaacctgctcaatttaacatagttggagttggtgaatcccccgaagtatttcaaagtagttatattttgcactgtgaagggcccaatggacagcctggcactattcaaccaattataacttctgtacctgtaaatatatgggggagagatttattacaacagtggggagcacaagttctaattccagaacaattatatagccctcagaatcaacatatgatgcgtgaaatggggcatgtccctggtatgggactagaacaaaaaatttgcaaggtttgaaaaaaccgcttcaagcagaaagacaaagttcctgccaaagattgggatgtcatttttgatggtggccgttgttaagcctccagaacctatacctttaaaacggttaacagataagccaatttggatagaacaatggccgctaagtaaagagaagctggaggctttagagaaattagttactgaacagttagaaaatgggcacatagctccaacattttcctcttggaattctccagttttcataaaaataaaaagtcaggtaaatggggaatgttaactgacttaagagccatcagttcagttatacaacctatgggagcattgcagcctggcttgccttctcctgctataattccaaaaaactggcctttaatagttatagatttaaaatactgtttctttactatccctttagctgagcaaggctgtgaatggtttgcatttacaattcctacggtaaacaacctgcagcctgctaagagttttcattgttttagagatgggtctagtaatggtaaagcttcttattctggatcaaaaagtaaagttttccagacgtcctatacttcagctcaaaaagcggagcttgtagctgtaattgaggtgttgactgctttcgatatgcctattaatgtggtttctgattcttcatacttggttcattccacacagttaactaaaaatgctcagttactatatcatacagataaacaactgatgacaaagacaaaaaaggaggagaaacagggattatgggacagcccatacacaattgaacctagcattattaactttaaattttttgagcctgcccaaaggccagatgttatcagcagctgaacagcatctacagaaaccagctgcaaagacagaagcagaacaactggtttggtggagagatccaataacaaaaagttggaaaataggtaaaataataacttggggtagaggttgtgcttgtgtttctccaggaccgaatcaacagccgatttggataccatcaagacacctgaaaccttatcatgagccagatgatgaggaagagattctgggaggatcccgaggaccccctggttgcagccatgttgaggctgacgctgaggaggaccccaactgtcacaagcaacacctgctgaacacagccacccacctggggacagaccaagaagctgtcacagatggcagaagaaaacctgaggaaagtgggacaaccagtaacaatgagtaatttaatggtagctatgatagcgatgatcaccattgccatgagtattccttcaataagggctgacacagagaacaattatacttattgggcatatttatcaatcttggctggcaataatgcctgaacgtaatcactctatgacgcagttacacatgctttctgatcttggtatttaccataataaatctgctcctataattgaggcataccgtcctcaaaaacctatttgtaaacaaaatagaacctggccagaaataatgaacatacttgtttaggaagaccgcattgcagaacaggcagaggtgctgcgcagagattcctatggaatcattatggactggtcccctaagggcatgtttagcttaaatcgcacctctcagtctgcgtgccacaaccacactatgttcagctgatctgaacaaaatgatcagatggcagaaatgataaaacatatgacaagagttcctattatctggaaccatggcagtatagtggcacctcaacctcaaatgatatggctcgttgtaggagctaaacataaggatttgtggaaactattaatagctcttaataagatcgaaatttgggaaagaataaaaaagcatcgagaaggacaccctacaaacttgtttttggatattgcaaaattaaaagaacaaatatttaaagcatcccaggcacacctgacgttaatgccaggaactggagtgcttgaaggagctgcagacagatgaaaagctagtaacccattcaaatggataaaaacacttggaagctctgtgatttcaatgatgattatgcttttaatctgtgttgtttgtctttgtatagtctgcagacgcggatcctgactcccgcgagaagtagctcaccgtgacaaagctgcctttgcttttatcactttgcaaatcaaagaagggggacatgttgggaacagacacccccctcccaaaatctggccataaactggcccaaaactctccataaacaaaatctctgcagcactgtgacatgttcatgatggccatgacgcccccgctggaaggttgtggttttactggaatgagggcaaggaacacctggcccacccagggcagaaaaccactcaaaggcgttcttaaaccacaaacaatagcatgagtgatctgtgccttaaggacatgctcctgctgcagataactagcccaacccatccctttatttgggcccatcccttcgtttcccataagggatacttttaattaatctaacatctatagaaacaatgctaatgactggcttgctgttaatagatacgtgggtaaatctctgttcaaggctctcagctctgaaggctgtgagacccctgatttcccacttcacacctctatatttctgtgtgtgtgtctttaattcctctagcgctgctgggttagggtctccccagctgagctggtctcggcacattcagtgtgtttacagagtgaaatgatacccataactgacattacttttctcgtggctacagatggtattttccctggaaatcttcctccagctttgggagtggtctcaagtgtgggggcatcagaattgcttggggtgcctgggaaaacacagatccaggctgtagattgtattagctcatggatgatttgattcaccacaaggtctgagaagcatttgctctacaatgttattttttaaattatttcactataattgttgatttttgtttttgttgtttgagacagggtctcactgtcacccaggctggagtgcagtggtgcagtcatggctcgcttctgccttgaacctctgggctcaagggatcctcctctctcagcctcccaagtacctgggactacaggtctgtatcaccacacctggctgagttttttagttttgtagagatggggtttaactatgttgcccaggctgttctcgaacacctagggtcaagcaatccccctgcctcggccttccaaagtgctgggattataggcatgagccgctgtgcgtggcagatagtttgatttttcatttgccattgaagtcattttacctcatggttttgaaataatttttggtcgtcttagcagtttaaaaatattcttttgttttttctcctgagtttggagcattcctgttactaattgcttttttttttttttttttttgacaggtgtacactaccacatccagctaatttttgtacttttttatttatttatttttggtagagatagggtcttgctatggtacccaggctggtcttcaactcctgggctcaagcagtcctcctgcatcagcctcccaaagtgctggaattacaggcacaaggcagcacgcccagccctaattacttttattaggccaaattccttgtgtggaattcctgtgctttgcacacaaattgtcaggttggccccagaaaggtggatcccattttcctctttctgtgcctatgtgggtgaccaatcttccgaatcctacaggagctgtggttgatctctgtcctctattggctgagataaagtccaccatggatttctgcttctttgattcattgtcagtccacacatagggacaagttactgtgccctcattagaaagccatttgctaagtgggaactccggggaggccaggcctgaaggagagtttgccgtcagtcatttcgatcagggatcagggcagagaccactgtcatgggtagagctgtcccgccattccccaggaggaaggcagggctgatggcaggggtggggtgggcagtggtgcttaaaaagaggagaggccccaggggtgggcagtctctttgctatagatttccttgctgtcagccccaagcacttagcaattcttgctgtcggattctcatttgctctcatctgtgctacaggaaatcagtgtcttgagccagatggggtggcctgagcctcgggcccctcacagcatccaagggcaaagtctcagcagagccattgcctaaagatgttaagattattaaatgaaagcacaacatgcctgcagaaacgtatacgaatcatcaacctacagctggaaacatttttacaaagcaagcccacccacggaatcaacacctgtgacaccgcttcccaccccttcccaacttcccccaccaaggtaacggctgtgtttcacgtcttctaactccatgaatcggttttacccattcttgaactttattgcatcaacataaaggaagaaactgaggcaaaattaacataaatagagagtttatttgggccacgtttgaggactgaagcccaggagacatagactcaagttaccctggcgataagctccaacaagcagcagatgcaaatggatttttaaaggaaaattgaaggagcagtttggtcgtttaccaggaatgtacattggttctttaaaatggcatcagtgccttttggccagaaccgccatcttccaggaattcgccaaaatgatgaatgcaaagggaaagaggagaggcacccggtacatgttctccaggcgttttggaaaacatggagttgttcctctggccacgtatatgtgaatctataagaaaggtgacactgtagacatcaagagaatgggaactgttcaaaaaggaagccccgcaagtgtcaccatggcaaagctggaagagtctacagtgttccccagcatgctgttggcattgctgtagacaaacaagttaagggcaagattcctgccaagagaattaatgagcgtattgagcacattaagccctctatgagccgagatagcttcctgaaacgcgtgaaggaaaatgatcagaaagagacagaagccacagagaaaggtacctggattcaactaagctccaggctgctccacccagagaagcacactttgtgagaaccaacgggaaggagcctgaactgctggaacctattccctatggattcatggcataataggtgttaataaaataaaagacctctggactataaaaatgtttctcttcattgagaagtgtggtgccccctcccccaaagaactatttaaagtaaattttagttgtgtcctaattcattatgtaatgtcttcaccattcaaacgtaatgcatttcctgctgaaagacgtgaggtagcttactgtgcaacaaattactcaatgagttagaaaatggccaggtattatgtatgaaatatttgtactggtttgaagatagtccctctaaatcatcaaggaagaaataaaataatttacaacaaaaagcttcagttattgattggctgaacgttgttgtttgtatcacacatttcagaaacatgaagataatgggcgaggactaagctctgattttttatcttgcccaaattcctttctaaggggtctggggagtcatgcgctacaaagcagaaattctcatcagatgggttttatttaactctgtatatcgtgacttactttccaacctgactctggcataacaacgaaaaaaaatcaaaatattttaccccaaaatacatttccttgccatactttgaaattgtcctgcaaagtctcttgtgggaaaaatccagattctattggaatcccctttcccctttgttttccttcctttcttttcagatccaggagataatcaactagagccaggtacacttttaggtctgataagaaacattttacaacctgctctctctgaagtctgctatctgagaacttcctctgcacagtaaaacttggtctccacaatccttcatcttaacctgaacatttcctttccgttaatcccaggtcttcagataaactcaaccaattgtaaaccagaaaatgtttaaacttacctacagcctggaagctcccgctttgagagttgtcccagttttctgaaccaaaccgttgtatttctttctttcttttttttttttttcgttttaaggagtggagagtttaataggcaagaaggggcaagaaggatgggagaaggaagaagctcccctgtacagaaacagagggatggggggctccaaagccaagagagggaacctccaaacccatatatttcatatatatatatatatattttttttttttttttgagatggggtctcacaatgtcacccaggctggagtgcaatggcatgatctcggctcactgtaacctccgcctcctgggttcaagcaattctcctgcctcagcctcccgagtagctgaaattacaggcacccaccaccacgcccagctaattttttgtatttttagtagagatggtttcactatgttggtcaggctgatcttgaactcctgaccttgtgatccacccgcctcagcctcccaaagtgctgggattacaggcatgagccactgtgccagtccctcttaaatatatttgattgatgtctaatgtctccctaaaaatatataaaaccaagctatatgtgccccgaccaccttgtgcacatgttctcaggacctcctgagggctatgctatgggccatggtcactcatatttggcttagaataaaccctgtaacatatttcacagaatttgactcttttcattgacatggataaggatcacattgtacaatttgtggtaacttttaggaagtctagacagtcagctagcctggaaactacagggaaggaaagaaaaagcctttgaacagtgaaccctaggcacagctgctggcatcattgttctctgggcctgataagtttgcaggtctcacattcctcaggctgctctgagccacttctctttcttatttcctcctttggatcaagatcttgctctctgaaagtattgatgatcaatattttattttattttatttattttttggaaacaaatgctcggtgcctcaaagaagaaccagcactgagactaaggatctctcagcaaggcaaatttacttcggcagaagggtatgtgcatctcacatgtgaagtaatggcaaaagcacacagaacaaaggaaagcaggggtttttattatgtctaacacagcttctgcttctgtgtctttcccctattggctagggttggaccacacagtctaaactagtcccagttggctaaacatttaaactttcttagataaggtaggcacgtaagggaggtgagaagggagagaaggggggtcatttacggagggactaggagggtaacctattccctaataaggaaagaaatgtggactggggttgtagcaagttcaggcatgcctaggcatattcagacaagctgcggtgcagcacaggcaagggggtatttggaattgtaggatagagaatgaggaaactggataagctgtttgaagaggaaacctaactgcatctaacattttatttatttattgagacagagtctcactctgttgcccaggcttgagtgcagtggtgtgatctttgctcactgcaacctgtttccagggtgcaagcaattctaatgtctcagcctccggagcagctaggactacaggcatatgccaccatgcctgactaatttttgtatttttggtagagatagggtttcaacatgttgcctaggctggccttgaactaactcctggcctcaagtgatccaccctccttggcctcccaacatgctgggattataggcgtgagcccctgcacctagctgatcaacattttaagtgtaaatttgcccagcatcactgggaaggctcattcccatggggggggggggggtaagaggagaggtgctctggctcatgaactcggtgaggtctccaggcagaagatattggcagcacaacgggacagagcagcgggatcccaggccgcctgcttggagagaagctgtggtgtcgcggatcattcctaagtgttctagctatcatgattttcgtttttattcttgactttagacatctagaaatacaaagcctaatcaagtgaagaataaaaaatatgatgcaaataaaatcccaatctggaaagcattcctattcctaaaggtaatcaatcatgtaaatcacgtgaggggtctgtttttctaccatcttgcagccattttgccttttttttttttttttttttttgagacagagcatcactctgttgctcaggctggagtgcactggcgtgatctcagctcactgcaacctctgcctcctgggctctagtgatactcctgcctcagcctcccaagttgctgggattacagatgtgtaccaccatacttggcaaattttttttattttttatttttttttatttttagtagagatggtgtttcgccattttggccaggctggtctcgaacacctgacctcaagggatccaccagccttggcctcccaaagtgctgggattacaggtgtgagccaccgcacccagcccatttaactttttgagtgatttctaattaatttcccacttctcgtcctggtctgaagaataaggtaactggctgcagatcagcttcagctggggatctccaggtggaaggtacccatgcatgcaggactgcctttttatttattttttttaattttacgttaagttctgggatacacatgcagaacgtgcaggtttgtcgcatagtatacatgtgccgtggtggtttgctgcacctatcaacccagcatctaggttttaagccccacatgtattaggtatttgtcctagtgctctccctccccttgccctttaccccctaacagggccacggtgtgtgtttttcccctccctgtgtccttgtgttcttattgttcagctcccacttatgagtgagaacatgcggtgtttggttttctgttcctgtgttagtttgctgagaatgatgccttccagcttcatccatgtccctgcaaaggacatgacctcattcttttttatggctgcgaggactgcctttttaaaatgagaaatgtgaatgcatgagtcagtgcctttgagtttagctgcacaaggaattggtaaacaatccccaacatgggcccttctggtgagctggagggagtcccttatttgatagaaagagtccttgatttgatgtcttttccaagaatcaaaacctcctagttgcaggccatgacctctgatgtcttcgtctcctgggtgctgactcttcaaagaatctttaatttagagtttttagtgagaagctgtataaggccttgcaatcatgaagaatgtcacctttagggtgagctggttcactgggctccttcctccaggcacatggggcttcctgcagttatttcaaagggagaaagctgaggttttccaaacaggtagaaggtaatttaagcaataccaatggaagagccttaggcaagacaaggttcaaagtttctgtaaactttgccatttgttcttgtatccattgtggcaggaaaataaggtctggaggcagggaacataaggccaattcacacttcagctataacaggaaatatcctctccatatggcatcactttacgtcatcctcttcatttacacagggtgtaccccaagtagagggtatttaaactcacataaactcacaaaaactctgtaacagggcctttgagcccctatgctcaggcccactaccacactgtggagtgtactttcattttcaataaaacccttcattcggctgggtgcagtggctcacgcctgtaatcctagcactttgggagacgaggcaggtggatcacctaaggtcaggagttcgagaccagcctggtcaccatggggaaaccccatctctactaaaaatacaaaaattagctgggcgtggtggcggatgcctgtagtcccagctactcgggaggctgcgcacgacaatcgcttgaacccgggcggcagaggttggcagtgagccgagtttgcaccactgcactccagcctgggcgacagagcaagactccgtcccaagaaaaacaaagtaagacaaagcccttcattctttccttgctttgtttgtgcgttttgtccacttctttgttcaagacaccgaggacctggacaccctccactcttaacaccgtctatgtgttccgccaggccagaggctgagggtggcatgcatagtgcagtggtgaaaaatcgccgtatgtcacaaatagaccgaattgtctgacaggtgaaatgggttcctcggttgctgtgcaacttggaggactccccaagaaggaataattttctctagcgaaaatttacctactgttcaggccatggctctacggcatggcaatgcttcaacccaatgagaaaacatggaaatcatgaccaggatgtacttgtatccttgagataaaggcagttggacaaaattcagttgccattttatctcaaaaggtcctgatgggaaatgtctcagggaaatgtccttgaggaacgtggagtgcttttcagaattgtgttgggacaagcaggatggggggagtacacttttttttttttctgagatggcgtttcgctcttgttgcccaggcaacaagtcttgttttgttttgttttgtttttgagacagagtcttgctctgtcacccaggctgcagtgcaatggcgcaatcttggctcactgcaacctctccctcccgggtccaagctattctcctgccctcagcctcccaagtagctgggattacaggcgcctgccaccatgcctggctaattttgtatttttttagtagagatggggtttcaccatgttggtcaatgtggtctcgaactcctgacttcaagtgatccacccacctcggcctcccaaagtgctgggattacaggcatgagccgctgagttcagccgagagtacaccttttgagccatcatgggtgatggtttccaggaatattatttttccatgaaattgtttttccatgaaatcgttttatctgactccagtgagttgactcatgaacatattgtaaaaagggtaaccaaagtcgcgagagaagaattggtctatcactgaactgtaccataaacccatttcaggagaggacgtgacatccccctcttacttttccaaagctttaactctttttcagggcctttctctgtgctttcttcagcgaggtttttttgttttgttttgtttttgagatggagtctcactctgtcttccagcctggagtgcagtcgcgcaatctcagctcactgcaacctctgcctcctgggttcaagcgattctcctgcctcagcctcccgggtagctggaattacaggtatgcaccaccacgcctggctaatttttgtatttttagtagagacagggtttcaccatgttggccaggctggtcttggactcctggcctcaagtgatctgcccgccttggcctcccaaagtgcaggaattacaggcatgagccaccgtgcttggcctccttcagcaaagttttaattggagcatatgcttgcagggatagctcgagatgtatagtttttgggtgaggaaagacacttcagcaacagttttggtcacagcctctgtgaaacagttgctcttaccatcaaaagtgtctggcttccgatgtctaggaattttgataagggccagtgatttcagtttctgaatgacctccaagagatcaaaggcctgttggccatttttaagggattgtctggaagaagtcaggaatctacgttatttccggagcatccccaaatcacgtgctgttgtaaatgcgcctctgctctctgtgtaaacttcagcaaccttgctttctgcgcatcgacaggctctggctaaggcaatcagttttgctgggtgggccaactttgcctctgggagagggttgtcttttaggacttcagtcacagagacagctgcatcaccttgcagtgttttccagaattgccatttaattaggggccatcagtaaaccaaattacatcagcatcctctgtaggcatctcctgtgagttctgcctaggagtgagaatttgctgggtcacggcaatacagccagggagcagcccatcagaaggcaatggcagcacagtagcagggctaagatccctacagtgagagagtaatgtgaggtgaaggcaagggaagaactccacataaagaagcctgtggcaagagtgatgctgcaaatgatgagtggctgaaattattctcccaatgtatgtgggtgcttgtgaccgtaagtggtgaggcagggtttgccataagttgctcacatcatccattggttccgaattcaaaatattttctttcttttttttatttttttgagacagaattttgctctattgcctgggctggagtgcagtggcacaatctcagctcactgcaacctccacttcctgggttcaagcgattctcctgcctcagcctcccgagtatctgggattacaagcacgcaccaccacacctggctaatttttgtatttttagtagagatggggtttcgccatgttgaccaggctggtcttgagcttctgacctcaggtgatccatctgccttggcctcccaaagtgctgggattacaggcgtgagcctccatgcccggcctcaggcatttctttgcagcaatgcaaaaatagtctcatgcagtccctatttgaaattctgaaacttgggccttacagtcatgggtgggttaggcactcccaccatttcagtggtttcgttcctctgaggaaggggacagttatatatgatggggttgagaacagagaagacagctctggtgtcagtgagagcaggagtctcttcactcagcagtggatccactcctcctaatgggagaggaaggagaaatagaaacgcccccttcggctccccagagcagctgtttctcttgggtggtttttctctcctgttgccatttaagttgtttgcaatctttttaaaggtgactttgtttcttgcaagagaagcagacccctctttggtcatgtgggcttatctgcatcttcttaagaggttgggtctggcaagtcagctgctggagctgccttcgttgaaagaagcgggttgaccagaagatctgcaagagtgctgtgggatttgctgagcctcttcctctggcggaggagggataggagagatggtaaccagagcatggaaggcctgacaaaagtggatgtagaggtgtgggaggaggcaacaggagagcagtggaaggagaaagagaagacattttcaaggttttctttagttgtgaaattgtttctgacaattttttgcttatctcctggacggaagccattttttccatacctctcttagaagcttctacctaccgttaaaataggactgctgttcaatttgtctggttctaaaacctgctaattgtatgcacaaacatattaacttagaaatttccaaagaccccgattttggccattgaaatttggggtcatcctgagtcatgtgggtgcatctggctgggtgtccacagcatggcgctctacaggggtgacccacaaacccggctggtgcttccaagggggattgccccttaaaggaaagctcagtttttgacaaccattttcccatacttttagaaattccttctcaaaagtgatcaaggctggaacagagcttctggttgaagtgtgctacttgcaagcgtcactccctaaggtcccagtgacaccgtgattgactgtcttatgtgtctcagaatccctggtccccttgcagtggtagagtgctaaaggcgccaggtgaccagcccttatgtgcaccttccagctggggtctgtcctgcagggaggccctctcagactgctacacatcatggacaaacatcccaacacccccataaaatctctagtcccctgcagcacccagctgggtttggagggagcaagtgtctcttaacttccaggtgagagaactcaccctcatgcaccctttggtttgaaactagcaggaattggtcacaattgaaaagacgagtccaaattaccagcaataggaaacagctacaattttaaaatcatgctatgtaactttaggtcaaaaaaagtgaaatcaccagtgctagtgaaaccacctttgcaaaaaagataacaatgaggaaattatgatggtgaaagagatctgacctaaccagctccatcttacctttcacctccaagctgcccttgttcattcctgagtgtaggccaaaggaggaagggagggatttatagcttaatgttgaagcaaagataacagcctctccccaaaacaaaccctctccttgcctggggatcagacagcctttgtagaactaacaaatgagccacagatgagaaattttggctcaggagtcacgcggccagaggccacaagattcctcacctccccagttgcccccataggtaacgttactattatgaaacctaaggttggtgtttgaggtgtttttcagaccctgcattctgatgggtcagctgaggctacactgactggtgaactggctcatctcgtcttatgatccccactcaagaaccaactcagcccaagaggacagcttcgactcccggcggtttcatccccgacccaagcagtcagcactcccacttcccatcctcctgcccaccaaactatctttaaaaaaatcctaaactttgaattttcagggaggctgatttgagtagcaataaaactttagtttcctgtttagccgatgacaacatgtattaaactgtttttatttatttatttatttatttatttatgagatagagtttcactcttgttgcccaggctggagtgcaatggcgtgatctcggctcatgacaacctctgtctcctgggttcaagtgattttcctgcctcagcctcccgagtagctgggattacaagcatgcgccaccatgcctggctaattttgtatttttagtagagatggggtttctccatgttggtcaggctggtctcaaactcccgacctcaggtgatctgcccccctcagcctcccaaagtgctgggattacaggcatgagccactgtgcccggccttaaactctttctttctctgttgcaattccctgtcttgataaattggcttcctctgaacagtgggcaagaggaacccattgggcagttacactagactccaacactgtaacccaaaacgctgccatgaggctgaggagaagacagacattctctgcagagcttttgcctaaatctcctgtccagagacagagacagaagccctcactcttgcaggaaagaaaggatttggaaaacagcccaaataaagtttcaacttcttcacaacagccaaaatttggaagcaacctacatgtccatcaacagaggtacttacacaatggagtactattcagccataaaaaagaatgagatcctgtcattttcaaaaacatggatggactagaagtcattatgataaatgaaataacccagtctcagaaagacaaacatcgcgtgttctcatttatttgtgggatctaaaagtcaaaacaattgaactcgtggagacagagagtagaaggatgattaccagaggctaagaagggtagtgggagggtgaaggggaggtgggttcatggatacaaaacaaatagttagaaagaatgaataagacctagtatttgatagcacaaaagggggactatagtcaataataatttaattttacattttaaaataacaaaaagagtataattgaattgtttgtaacataaagtataaatgcttgtgggactggataccccattttccatgataagattattacatgttgcatgtctgtgtcaaaacatcttatgttctgcataaatatatacacctatatgtccacaaaaaataaaaattaaaaattagaaaaagatctagacctcaaccaaaaggaagggaggtctgaattcaggactcaacctttgcacgcaaggaaacctctggagtcagaggaacacagagtgtttatactggttcggattgctgagtgtgagagggaatgccagttggctgcaagggaggaatagagctgaatcctccagacaacaccagaaatgccaaccaaaattaagaaactgaggccccaggcacggtggctcatgcctgtaatcccagcactttgggaggccaaggcaggaggatcacctgaggtcaggagttcaagaccagcctggccaacatggtgaaatcccgtctctactaaaaatacaaaaattagccaggcatggtggcgggcacctataatcccagctactcgggcggctgaggcaagagaatcacctgaacctggggggcggaggttgcagtgaggcaagatcgcgccactgcactccagcctgggcgacagaatgaaactttgtaaaaaaaaaaaaagaaagaaagagagagagaaagagggaaagagagagagagagagaaagagagaaagagagaaagaaagaaagaaaagaaagaaagaaagaaagaaagaaagaaagaaagaaagaaagaaagaaagaaagaaaagaaagaaagaaagaaaaggtatcccatggtaatcccatggtgagatcctatggtgagatcatagctcactgcagcctggaactcctgggctcaagtgatcctcccacctctgcctctagtcctagtctttgagtagctaggactgtaggtgcatgccactatgcctggcttttttttttttttaatagagatagggtctcactctgttacacaggctagagggcagtggtatgatcacagctaactgcagcctggaactcctgggctcaagccctcctcccaatccttggcctcacaaagcaccgggattacgtgtgcgagccgccaaactcagccacaagtcagtatttaaaggaaaaatggggcagttcctaagttgtttaccaaaaatttttattgtttcattaaaataacctattgatttattagacatcgttctttgtatcacaaattccaggagcatgaagataatgggtgaggctcacattgtgcaacttgtggtaatattttaggtaatttattagctagcctggaaactacagggaaggaaagaaaaaaacaaagcccttaaacagttacccctgggcatggctgcgggggtgtgactgaggtcccatgctcctgtccctctggacctgatacattttgcagacccccccccattcctcaggctgttctgagccacttttctttatcagttgacaaggatgcacacccatgtactctttgtgtctggcttattcactcacaattaaacttattcactcacttgctggaagttgccaggtcatagggtttgggtaggttcagctttagaacacactgccaaacagtttctccaggtgtttgtacaaagtgcactcccggccgggtgcggtggctcacgcctgtaatcccagcactttgggaggcagaggcgggtggatcacgaggtcaggagatcaagaccatcctggctaacatggtgaaaccctgtgtctactaaaaatacaaaaaaattagccgggcgtggtggcgggcacctgtagtcccagctactcgggaggctgaggcaggagaatcaccagaacccaggaggcggacggtgcagtgagccaagatcgtgcgccactgcactcccgcctggcgacagaacgagactctgtctcaaaaaaaaaaaaaagaaaaaaagtgcactcccaccagcaaagtgagatgcctctgggtgctgggtatcctggtgaacacttggtattctcagttgctcagctggtggcgggtgcgtgattgtatcactgctttgtagatttgaggctgctggggatagcattcgacatccaagacctgcctaaggagaggaatctaataagtctcagaaagtttcaaactctttattttcactcagttttcaaagacatatgttaattaactgtccattacactgcagactgactgagctgggctccctctgtttctatatgcaattaagttactcaggaaacactttcttttttaaaagctttgataaataggttataagtatatttaaaactacatggaaattaaaatgttattgctgtatgcaatgctataaatgagataaaacatgcaaatctgatggaattctgtgccaaatagctagtctttctttctttctttttttttgttttttttcccgagacagaatcttgctctgtggccccggctggagtgcagtggcgcaatctcaggtgactgcaacctccacctcctgggttcaagcaattatcctgcctcagcctcccaagtagctgggactacaggtgcgtgccaccacaccccgctaattttttgtactttttttttttttttgaaacagagtcttgctctgttgcccaggctggagtgcagtggtgcgatctcggctcactgcaagctctgcctcccgggttcacgccattctcttgcctcagcctcccgagtagctgggactacaggtgcctgccaccacgcctggctaattttttgtatttttagtagagacggggtttcaccgtgttagccaggatggtctcgatctcctgacctcgtgatccacccgcctctgcctcccaaagtgctgggattacaggcgtgagtcaccgtgcctggccatttttttgtattcttagtagagacagggtttcagcatattggccaggctggtctcaagctcctgacctcgtgatcagcctgcctcgacctcccaaagtgctgggattacaggcatgagccactgtgcccggccaatatctttcaaatagcaaaagtaactctcagaacacagtctatgcaaatcacagcacaaagtgctccagcaggagggacctgttctgtccacctatgtcagcatgatctgcagtgatcaggcagccttgccatggggcagcagaagtgagaaaccctgccatggggcagcagaggtgagacaccattccaggaaatagatcgaaactccagtgtgtactaatggatactacccactggctgaaggcttgaaactacctttgcaaaattctgacagaaagggaaatctgacatagctaactccatcttgctgttctgtgcaggaaaagtgcgaggggagaagaaaagacacacacacaatacctttaagtgtaaacaaccttcatcttacgtggcaatgcagatataataagcaaattatataataagcaaataatataataagcaaattcatataataagcaaattgcagtgggaaagggagaaggcaaaatatatatccatatgtgtgtgtatatatatattttttttttttttcggagatggagtcttactctgtcacctaggctgtagtgcagtggtgtgatctcagctcactgcaacctcaatctcccgagttcaagctattctcctgcctcagcctcctgaataactgggactacaggcgtgcgccaccacacccagctaatttttgtatttttagtagagacagggtttccccatgttagccaggctggtctcgaactcctgacctcaggcaatccgcctcccaaagtgctggggttacaggcgtgagccactgtgcccagccaagatagatatatatatttacactcaccaggctatggaggattcactgccagaccgggaagcaacagcctgggctccagagttggccacccgtctgtgcacagacaaggagaggtctcatgaagcttcgatgtggtctggggtcctagctctttttgtaacgagctgtttggcgtgaggcccagtcacgaggggcctttgtgactgggctcaaggaacacaaaagggccaacttgcttttgcaattttctattgtttttcaataactaatgtataggaatagattgaattagagatttctccaaaacagcgctggataaacgcctcaaggggctcacacaacccgtttggggacttggtggccattgtttgtgtccatgttcaattgagttcaaatttaatgtttaacttttcctccacacttgcctctaacctccaagttgtccttgttcatttctgggcaaaagccaagctaacttcgggaggaatttagtttatagtttaacactgaagcaaggatgataatagcccttccaaaactatctcctcttcattcaggaaccaaaactgtctttgtaaaactaacgaaagaccccaagattagaattatggctcaggagtcaggtagccagagatcacaagacttgtaacctccccagttgctcctatagataacataattgaaaaactaagattcgtgtctgatgtatttttcagaccctgtattctgatggatcagttagagccacctggatcagtagcccataccaagaagctggctcatctggtcttgtgatcctacccaagaactgactcactgcaagaagacagcttcagtcgcatgatttttatctctgatccaaccaattgttatccccattccctagccccatgcccaccaaactatccttgaaaaaccctaggctcccagctttcagagaggctgatttgcataataagctctggtataccacatggctagccttgcactgattaaactctttctctactgcactactactgtcttcataaattggctgtcctgtgcagctggcaaaattccattgggcaattacaggctcagctcattctccattataattttgtttaaaaatgggccaggcgagtgactcatgtctgtaatcccagcactgtgggaggccaggatgggaggatcacctgagcccaggagttcaagaccagcctgggcaaatagtggaatctcatctccacaaaaaattttgttagaagttagccaagtgtggtggcatacaacagctgtcccagttactcaggagggtaaggtgggaggatcacgtgagcccagaaggtcaaggctgcagtgagccatgactgcataaatgcactccagcctgagtaacagagtgagatcctgcctcaaaaaaaaattataaaaaaaggtataaaaatgacagccgactctatgaatatactaaaaccagtgaattgtacactttatacaaatgaaatagcaccaagtacgggtgttgcttaaaaggacacctttggatccttcataggatgtcaccattagaggatctggggagaatataggactctattatttgcaacttcctgtgagtctataatttttcaaaataaaagtttaaaaatgggttagataataacaaatctcagtatttactaactccaatagaataattggagaaatcagtcaaaatatttaaaagtgaccctggccccattttccagcacatgcccaaggtcctgggtgctgagggagccgtgggtcctccttccctggggtggagccttctctgtccctgggctcctggcacagactccctccaggacccagatggggtgggcggggtcctcacactgtgccctctccccaccctgcccgccccagctcagggccggaatccagggatcccaggctgggtcccacccacggtcatatctccctgtggctcctggtctctactgcacccccagcctcggcactgggttgaccctggaaggcctcctgggtgcaggaaggggtgggacccttgtctttactcgcatgtggcggcatccccctggcagcgggaagggccctcccctggacacatctgtgcaggttccaataaccagtcacacgggagcgtttgggcgcagcattaaaaaaatgctccgagttaatttcctgggcccagctcctttccactctggatttcagcctcttaggagaataagccagcgaagtggggttgggccgcagacacaggagtgggagaaaagtggaggggagggtccatgtagtcagaccaatactcccactgaaaccagatcatatggtggactcagtgttttaatgctgtggttttggccaggcatggtgtctcccatctgtaatcctggcactttgggaggctgaggcaggtgggtcgcttgagcccaggagctcgagatcagcctgggcaacatagccagaccctgtctctaaaaaaaaaaaagtttttaattagccgggtgtggtagtgcacacctgtagcctcagctactggagaggctgaggcaggaagatggcttgagctcagcaggtcaaggctacagtgagccatggtcacaccactgtactccagcctgggcaacaaagagagattttgtctcaaaaaaaaaaaaagtgtctttttaaaaaactggaatgctggcaagataatcaccagacccaatggaagggaagcaggactctgtggggtcagccaagcaggaggacccaggagagtttagggggtgaatgagaacattgattcccatgggctctgggggagggaaaacaacacaacccttgggtcctggagtggggtgtctacgggaaatcccctccacgctgtactgggcgcacaaagggagttcgcccagaagcacgtgcacagcctctggggcgggcgcctgcattgcacccctcaaaatattgctaccatgatgtgcaaggacaaggtggggcacaaaggtagccaagcaccaaagacagaagccaggacaaagaggggctccagaccacagaaacatgcccaccgggcggcagagcaggggacagactctgtgcccccgtacttctattccatgtcctgggtctcacctcacacctttcttgcagttcatgtgtctctcactgtgtccacaatgatattctacacatccagaagggtttgtagtaattatagggttttttgtttctataactcatatttatttatttttattggtacacaataattgtacatatttatggggtacgtgggatattgtaatacatgcatacaatctgtaatgatcagatcagggtattaggatattcatcgtctcaaatgtttgtcacttttttttttgagatggagtcttgctctgtcacccaggctggagtgcggtggcacgatctcagctactgcaacctctgcctcccagattcaagtgattcccctgcctcagtttcccaagtagctggaactacaggtgcgcgccaccatgcccagctaatttttgtgtttttagtggagacaggggtctcgccgcattggccagactggtctcaaacacttgacctcaagtgatccacccgccttggcctcccaaagtgctgggattataggtgtgagccatgtggaggaaaagttaaatattaaatttgaactccattgaacttgaacacaaggaatggttatgtgccagtaaatagcctctgggcatctgcctgggagctaataacctatactgattgttctggtaaggtacattttctaccttaaggcaaacaaacaacagaatctacagaataggctaaccttcctgtattccctgagtccagtcatgaagggccctcgtgcctggggctcaggccaaaaaaggaatactacaaaagggtgagggtcccagaccccgccgaagctccgcaagaactctcctcgtctgtgcgcggacgggcggccgactctggagcccaggctgctgcttccctgtctggtgatgcttcctccatagtccagtgggtgtaaatatatacagatatatcttttcttgtccctttcccactgtgatttgcttattatatttgtgttgccatatacttgggatgaaggctgtttgcccttaaaagtatcgtgtgtgccttttcttcaccccccgggcatttcccacacagaaacttttggtatcaggaacaggattcgaaaacgaaagtatgccactttccagtcgcagggactgggctggaggctcggggacttcccacatcccgggatgggaacttccccagttctccccctcggcgactgaatagtccaggggaactggcttttgtgaaaattgggaatctaagttagtgcattttgaactgttggctgtgtgtgaggtgctgcaggaaattctagtttgataaggggatgccgagggaatttcctggcatggatgctgcttgcttactgcttataagttaatgtgtcaagatagggaccggttgctacaaaagaaatgtaagctggaaaaggaaaatgctaatttgacttccagactggccctggcccaatgccaggcctatgtcttgactgatcaagctcaaagctagtaatgcttcctccatagtctggtgggtgtaaatatatatagacatagctcttcttctccctttcccactgcgatttgcttattatgtctgtattgccatatacttggaataaaggtgtttacccttaatagtattgtgtattgtgccctttcttctcccctctcgcgtctcccacacagaacaatgtccagcagtattttttagtaactacagttttttttctagaattcatatttattttgttggtacacaataattgtacatatttatgggggacatgggatattgtaatacatgcatacaatttataatgatcaaatcagggtattagaatattcatcacctcaaatatttgccatttctatgtgttgggaacatttcatatcttctcttctagctttttttttttttttccttgagatgaagtcttgctctgtctcagactggagtgcagtggcgcgatctcggctaactgcaaactccgcctcccgggttcaagtaattcttttgcctcagcctcccaagtagctgggactacaagcatacaccaccacacctggctaagttttgtatttttagtagagatagggttccaccgtgttggccagcctggtctcaaactcctgacctcaagtgatccacccgcctcggcctcccaaagtgctgggattacaggtgtgagccatggtgcctggccatcttctagctattttgaagtatacaagaaattatttttaattatactcaccctactatgctatcaaacactagaacttattccttctaattgtatgtttgtactcagtaatcaatctctcttcatccccacgctgcacctttcccagcctctggtaacttatctttctactttctatctctatgagatccacttttaaaactcccacatatgaatgaaaacatgcaatatttgtctttttgtgcctggcttatttcaattcacataataacctccagttccatccatgttgctgcaaatgacagcgttttattttttatgggcaaatagtattcaaattgtatacacatacacatatatattcatctgttgctggacatataggttgattccgtatcttggccactgtgaatagtgctgcactaaacatgtgagtgcaggtatccctttgatatactgatctcctttcttttggataaatatccaggagtgggattgctggatcacatggtagttctatatttagtattttgagaattctccatactgtttttcataatggcatgctaatgttcattcccaccaatgttgtataagagttctcttttctccgccacctcaccagcatttatttgttgtctttttgaaatagccattctaactgggaggagatgatatctcactgtggttttaacttgtaattccctgatgattagcgatgttgagcatgttttcatatacttgtgggtcatttgtatgtcttcttttgctaaatgtccattcagatcatttgcccattttaatgtggttgttttttggctgttgagttgtttgaatccttgtatcttctggatattagtcctttgtcagatgaatagtttgccttcattatgttgaggtatgttccctctatacttaatttgttgagagtttttatcatgaagggatgttgaattttatcaaatgctttttctgcatctattgagatgatcatatagtttttattcttcattctgttgatgtgatatatcacatttattgatgtgtatatgttgaaccacccttgcatccctggaataaatcccacttgatcatggtgtattatctttttgatgtgttgttggattcagtttgctagtatttgttgaagatttttgcgtctatgtttatcagagatactggcctgtagttttctctttcttcttttgtcatgtccttgtcttatttttgatatcagggtaattctggcttcatagaatgagttaggaagaattccttcctcttccactttttggaatagtttgagaagaattgatgttacctgttctttataattttagtaaaattcagcagtaaaaccatttggtcctcggcttttctttgttggaagatgtttcattactgattcaatctcattactcattatttgtctgttcaggttttctgtttcttcctggttcaatcttagtaggatatatatattcaggactttatttcctctaggttttccaatttattagtgtatagttgttcataacagtctctaatgatcctttgtatttctgtgtgttcattgtaatgtctcctttgtcatttctgattttatttgggtcttctattttttttgttagtatagctagtggttcatcaatttttcttgtattttttaaaaactaactttttgttttgttgatcctttgtattgattcttcatctttattttgtttagttctgttctgattttatttctttcctttggttgattttgggttttatttgattttgcttttccagttccttgaggtacatcatcaacttatttatttgaaatctttctattttttaatataggcttttattgctataaacttctctcttcacactgcttttgctgtatcccataggttttggtatgttgtgttcctgttttcatttgttttaagaaatttttggatttttatcttaatttcctcattgacccagtggtcattcaggagcatggtgtttaatttacatgagtttatatagttcccaaagttcctcttgttattgacttctagtttcattccaatgttgtctgataagatatgtgattgattttgactttttaaaatattttgaggcttgtctgtggcgtaacatatgatctgtcctggagaacgatccatgtgctgatgagaagaatatatattctgcatctgtcaggtaaaatgttctgtagatgtgtgttaggttcatttggtctaaaatacagtttaaatctattttttttggttgattttctgtctagattatttgttcaatcctgagagtagggtgttaaattccctaactattatcgtatcggaatctacctctccctttagaactaataacatttactttatatatctgggtgctccagtgttggatgcatatatattaagaactgctttaccatcttgcttaaattgatcactttatcattatataatgaccttctttgtctctctttatagtttttgacttaaagtctgatttatctaagtatagctattcctgctcacttttgggtttcatttgcatagaatatctttgttcatctcttcactttcagtctatatgtgtcttcacaagtgaagtgagtttcttgtaggcaacatagagttgggtcctgtactttaatccattcagccagtctatacatgtatatctatattttttgagacggagtttctatcttgttacccaggctggagtgcagtggcacgatctcagctcacagcaacctcctcctcccagattcaagaggttctcctgcctcagtctcccaagtagctgggattacaggtgtctaccaccttgccgggctaattttttttttttttttgtatttttagtagagacagggttttgccatgttggccaagctagtcttgaactcctggcttcgggtgatctccctgtctcggcctctcaaagtactggaattacaggcatgagccactgcacctggcacagtctatattttttaaatggaatagtttttttttaatgtacagagtctcactctgtcacccaggctagagtgcagtggcacaatctcatctcactgcaacctctgactcccgggttcaagtaattctcatgcctcagccacctgagtagcttggattatatgcatatgccacaacgcccagctaatttttgtaatttagtagagacagggttttgtcatgttggccaggctggtcacaaactcctggcctcaagtgatccgcccaccttggcctcccaaagtgctgggattacaggcatgagccactgcacccagccttaagtggagaatttaatccatttactttcaaagctattattgatgggtgagtactcatgcctgttattttgttaactgttttctcattgttttgtatatcctttcttcctcccttactgtttatcattgtcatgtggtggtttttcatagtggaaacatttgactcctttctctttctcatttgcatatctactctaccagtgagttttatactttctgtgttttcatgatgataggtatcttctagatgttagactcccttaagcatttcttataggaccagtccagtggcaattagttctctctgtttttgctcatctgacaaagactatttcccttcatttttgagggatagctttgcaggctatactatgcttgactggcaggtttttctttcagcattttgaatgcatcatcacgttcccagcttgtgaggtttcttctgggaactccactgttagtctgatgagtattcccttatatgtgacttgacactttactcttgctgtttttaacattctctctctctctctttctctcactctctctctctctttttgagacagggtctaacactgtcactcaggctgaagtgcagtggtataatcatggctcactgcagcctcaacttcctgggctcaagtgatcctcctgcctcagcctcccaagtagctgggactacaggtgcatgccaccacacccaactgatttttttatttttgtagagatggaacttgctctgttgcccaggctggtcttgaactcctggactcaagttaacctcccacctcagcctcccaaagtgttgggattacaggcatgagccaccatgcccagcctctctttgccattgacatttgacagtttgaccataatgtgccttgaagaagacctttttgttgtgtatttgagaatcttagagcttcctgtatctggatgtccatatctcttgtaagagttgggacattttcagctcttatatcattaaaaaggttttctacacttttgcccatctcttcttcaggaactccaaaaagttgaatatttggcaacttacggtgtttcatatatcatatagcctttcttcttattttttactgtttttcttttcttttcttttttgagacagggtcttgctctatcacccaggctagaatgcagtggtgcaatctgggctcactgcaaccttcatctcccaggtgcaagtgatcctcccacctcagcctcccaagtagctgggactacaggcatgcaccaccacacctggctaattttttgtaatttttgtagaaatgaggtttcgccgtgttgcccaggctggtctcacactcctgggctcaagcaatctacccacgtggcctcccaaagtgttgagattacagacatgagccaccacacccagcactcttttattttttgtttgacaaggctatttcaaaagccgtgttttcaagttccaaaattatttcttctgcttgatctagtctattgttgaagctcttgattgtttttattttattttattcttcaaacctggaacagaattcttcagttccaggattcccatttggcattttttaatgatggctctgttttttttttttttaacttttttcatttatatcatgaattgtttccctgatttccttttttcttttttttctttgagatggagtctggctctgtcacccaggctggagagcagtggcatgatcttggttcactgcaacctctgcctccccggttcaagtgattctcctgcctcagcctcccgagtagctgggatcacaggcatacgccaccacacccagctaatttttgtgtttttagtagagatgaggtttcgccacattcgccaggctggtctcgaactcttgacctccagtgatccacccgcctcagcctcccaaagtactgggattacaggcttgagccactcccccggcccctgatttctctgtattgtttatctttgctgtcttgtatctcactgagtttttaaacttattttgaatttttttgagcatttcatcatttctttaggatctgttcctggagaaatattgtgttcctttggaggcgtcacgtttcctttgtgtgtgtgtgtttcttgtgtccttgtgttgatatctgcgcatctggtgtaacagtcatttcttctaattttatggattggcttttgtagggaaagacattttcctgtagatacaccgataatgttggttggtattgtagtctgttctcacattgccataaagaactgcctgagactgggtaatttataaagaggcttaatcggctcacgttcccacaggctgtccaggaagcacggctggctaggcctcgggagaccttccatcatggtggaaggtgaaggggaagccggcacatcctttgaggctggagcgggaggaagagggtgaagggggaggtgccacacacttttaaacaaccagatcttgtgagaactcagtcactatcacgagaacagcaagggggaaatccgcccccttgatccaatcacctctgtccagacccctcctacaatttaacatgagatgtggctggggacacaaatccaaaccattccattctgccccagcccctcccaaatctcatatccttctcacactgcaaaatacaatcatcccttctcaacagtccctcacgtcttaactcatttcggcattaactcaaaagtccacagtccaaagtctcatctgagacaaggccagtcccttccacctatgagcctgtaaaatcaaaaacaaattagttacttccaagatacaatgggggtacaaacattgactaaatactaccaatccaaaaaggcaaactggccaaaacaaaggggctacaggccccatgcaagtttgaaacccagcagggcagtcattaaatcttaaagctccaaaataatctccttcaaccctgtgtctcgtatccaggccacattggctcaaggggtgggctctgccctgtggctctgcaggatgcagcccccacagctgtggtggcaatggggagccaggtgtgctgatttgcaggcccctgggtggcatatgcaggtgctaatggtggtgagtccagataggccagtccttgggcctccagcttgctcaggcgccaccagtaggcagggcaggtgggctcctgggcagtgtgtgtggcaacaatggtggcagaagtgatggtgggccaaccctggagccatcaggcagcatgtagcagttgggtgcttttccatccatcccaatcacggaaaattcccgattcctgtagaattaaaggagaattacgaagagaatatcaagatatgcaatgacagagccttctgggtgtagctgcttccagctacggggtttacgcaatagagatatgaccaacaacaattagcatcacttcagaaaaagtactaaagagaccacagaaagctttgtggaggcgctggctcacacctgtaatcccagcacttcgggaggccgaggcagatggatagcttgaacccaggagttcaagaccagcctgggcaacatggcagcaacatcccctctctacaaaaaaatttaaaaattagggccaggagcggtggctcacccctgtaatcccagcacttcgggaggccacggcgggtggatcccgaggtcaggagatcaaggccatcttggccatcatggtgaaaccccatctctactaaaaatagaaaaaattagctgggcatgtgcttgtagtcccagctaatcgggaggctgaggcaggagaattgcttgaacccgggaggtggaggttgcagtgagccgagatcgtgccactgcacgccagcctggcgacagagcaagaatctgtctcaagaaagaaaaaaaaaattagccgagtgtggtggcacatgcctgtagtccctactacttgggaggctgaggtggaggatcacctgagcccgagagattgagactgcagtgagccgagtttgcaccactgcactccagcctgggtgacaaaatgagaccctgtctcaaacaatgaataaataaaagctttgcagcccaactaaagtctccagattccttactttaaatggttttagcaaaatgcttaggttttatatagctaattgcttaggttttatatagctaattgctacaaatgtaactaaaaccaagattgcagtagctcaatgtatagaacttacagataagccaattttgtaaccttgcattttggctttggtttttggctcttacattgcttaaagtttttcaggttaatgaatgtctggctgcctccattcccatctggcctaaaatgtttaattgactgcaagtcttttggctgtaagacccttggccatggggttccgccgagggcctggatggacctggggcagggagccacaccaccctggcaacgatatgggacaaaattaaagtttagccactgatgctgcctctggaaaatcttgaccaaagtgaggaaaagagacataaaaattatatcctaagcccccaaccaactgaactgagcccttcttggccaaggggaccccagagataccttgaaaactgagttccaggccatgatgggaacgcaggtcagacacgggagggcaggtcagacacgctcccctttccctctccagctgcccttaggctttctcccctgcggactgcggtccacagaccccaccccgacatcaaccagactctgacgctgccgcttccttttgcattttcaatacaaccttaccaaccagcatcccctcctgataagagaccaccgacctcagagtggttctggccagtctacggaggatgcacagtgagggttttctctgcttccccttttgacatcagaggcccaaaaactccacccttggaccatgtgaaggctaccattttttgaacgtgggtcccatggagaggcatgaagctcaactgtgtatgttcatatttctcctctcataaatattcatggatcctcctaaagcttattgaatatgtatatttggccaccctggtcaatataaatccctgtgttaccattcctaccctccaaatatctgtttctagcttccagccagaggctatgcttcccagcctgtcagaacggccaccttcaggctgcaaccctttaggaggaataaagctatcctttccaaactagaaaaaaaaattacttgtgggagtactttgggttttggggggttgttttgagacagagtctcgctctgtcacccaggctggagtacagtggcgtgatctcggctcactgcaacctccgcctcccgggttcaagtgattctccagcctcaacctcccaagtagcggggattacaggcacatgccaccacccctggctaatttttgtatttttagtagagacggggtttcaccatgtcagccaggctggtctcaaactccagacctcgtgatccgcctgcctcagcctcccaaagtgctgggattacaggtgtgagtcaccgcgcctggcccagcaattcaatatttttaagatttttaaaaatatgtattttatccagttagttgttctcattgggaaatagtttagcccagagttactggagacaagagttttactccatgcctgtcccccacctgattgcctagctggaaatagaggtctttgtttttatgagctgcctgaaatcctaaacagaaggaagtgccactcaaagcttccttttataaccaatccatatcccaaactggcatatttgggggtggcatttcctgaacttcagtgttaaggatttctgccacagatgaagggggtgttctgcctggggggtgtcaggtcgcagggcctgaacaccctcttcccagccaccatctggggagacagttctgctttccaggtgttactgaaagtactgaaattcttgtggggaaactgaagaactgcctgaggcctaaaagacatacagccagtccccgaaaggagtgttgaggactgaagtcttgccgggtctcagcgcagtgaaaggttttttggtgtttgtttctttgttcattttgaggggaccttttattctaccacaatatcacacacaatataaactgaataccagggtcctccacaagccactgcgcgggctagcattttccctcgacaaagctaggaagcttatacagataaaagttagttttgagttttcacatttgattttgaaaaatgttcaaatgcctaaggcagaactaaagtctcagctctgcgagtccatgggctgtagagaataataatgcctggaattcacatacagacacacacacacacacacacacacacactcccacacacacccccccacaccccccccacacacacaaccccccccacacacacacacttcccacacacaccaaagccaaacaccagcaaccttcccaaggttttgtttgtttgtttttgagacggagtttcactcctgttgcccaggctggagtgcaatggcgcgatctcggctcacaacaacctccgcctcctgggttcaagtgattctcttgcctcagcctcccaagtagctgcgattacaggcatgtgccaccatgcccggctaattttgtatttttagtagagacagggtttctccatgttggccaggctggtcttgaactcccgaactcaggtgatccgtccacctcagcctcccaaagtgctgggattacaggcctgagctaccacacccagccaattcccaaggttttacaaacacagctagaaaggcaaacaaaaagagcatcttttctttacataatttcattctgtttaacatttgcattattgtcaaaatattcaggtgttcagggaaaaaatgttgcttcaataaactacaggggaaataatgctgttagttgtagaagctgattttgctccattctgacaaaaaaaaaaaacaacaccttttgaaagtacagggacatttcagcaagtaggtcaggcattttatatatgtaaatgaaaaaaaaaacaaatccacccagaaagctgcaattctaggttgtaaatgaatctaaaacgtgtgaaaaactgttcagttcagtgccctgaaatctatttcaaacataactgtaactcttacaacattaaggcttaggtcactgccaggcacagtggctcacgcctgtaatcccagcactttgggaggccaaggcaggaggatcacctgaggtcaggagttcaagaccagcctggccagtatggtgaaaccccgtctttactaaaaatacaaaaattagccgggcgtggtgccgcgtgcctgtagtcccagctacttgggaggctgaggcaggataattgcttgaacccgggaggggaggcagaggttgcaaggagcccagatcgcaccactgcactccagcttgggcgacagaactagactctgtctcaaaaaaaaaaaaaaagtataagggtcacatcatacacaaaagagaacacccatctctacaggagtgccggctccagagtcttcggggtctcagagaagacccagaaacaaggtctccacgaattaaagcaccatcaggagagaaagaccatccggatatagtcaatcagtgcgaggcagccacatacacaagtaacccttgtttaagcgtcagtgtacgcattttcggttacatcttatacggcactatgtacgtgagtaacgcttagcttcagtttaaaaaatacaaggacggacactgattaagaaaagcaatttttggccgggcgcggtggctcacgcctgtaatcccagcactttgggaggccgaggcaggcagatcacaaggtcaggagatcgagaccatcctggctaacatggtgaaaccccgtctctactaaaaatacaaaaacaaaatagccaggtgtggtggcgggcgcctgtagtcccagctactcgcgaggctgaggcgggagaatggcgtgaacccgggaggcggagcttgcagtgagctgagatcgcgccactgcactccagcccgggcgacagagcgagactctgtctcaaaaaaaaaaaaaaaaaaaaaaaaaaaaaaaaaaaaaaaaaaaaaaaaaggaaagaaggaaaggaaaggcaaggaaaaggcaaggaaaaggcaaggcggcgcaaggcggggcaaggcgaggcaaggcaaggcaagtggggcctgtcctccacctgggctccagcggtgacacaggacgtcccgccgcttccagcttccgcgtacctgcgcgcacaccgggtcccccgcggcctcgccctcgtccatgacctccagagccccgcgccgcgcccccgcccgatccgcggaggcctccaagcagccgatgccctcgccaagcctgggtggtccagaaggacgcgcccgctccggggcgcagagctcttgaggtcgtgggcgggcgcagggccccggcggatacttggcagaggcttggggtcgtggcgggggcgcctcccttccggtgcgcgaaaaagcaaacgcgacgcgcgggctgcagagactgggccgggcggaggagacccccagcctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcaccggggtctcctggcctctgcgcgcagctggtcctgcagcgtcaggacccgaacgaccccgaggccccaggggctgggccctccagcagccccgcagcagccccgcagcagccccggcaggcaccctccagcggccgtgggcgcctggtagctatggaggcggtagaggtggaaaccaggcctctgtcttcacacaggaggaactccaggccctcgtttaggactccaggccaaaggctgtgtcagccgcgggtcccccgccaccccacgcgcacaggcgcaggcctcacaccgcgtgcccgacgacgccccgaggggccccggtcgcagttagtttgaagggaatcggtggtacagatcgtggcttggagaacgcggcttgacctgcggccagaatcagactcattccgaacacgcggcggccctggcccagctggcccctcccacgctcccgcggggattctcctgcagccggagcccctccccccactcgtgccctcttcccatcaagccctggtccccaggtgaccggcataggagactcctgtcccttcaggcgaagcccagcgcctccctcttcgggtggtctcgccttttggcttcaagaagtcaatctcagacagtctagtttgttcagcttgcatgaattttaaggtattttaagagcacttttctttatattttgataacatttatttcttaaaattacaaatgcagtatattctggttttgaaatcagttcatagtaggagatgttcaaacaaaagaataaccaaacaaccaagtaaattactgagtcgatcatgggagccaccattttttctccagcctttttttttttccagaatgccttttcctaccagattttatataatttaatgttatccctccccccaaataatttttaataaaaatcaaaaagaaccaccatcactgtttacaacttgttttttaaaaatattgaaaaccaccccctacctccaccctccacttccaatcccccaggagtaactagtagtaacattttccaaatatacatatctatattgataaatatgtgaccttattttacatattcttatgaggtgactgttcaggtctcttgcccatttttatattcagctgtctttttcttattggtatgtagttctttctatattctggataggaatactttgtcagtaatattggactgcaaatctcttctccaactgtgcagtttgcctttttactctgtcaatggtgtcttttgattaagagaaactctcagtgttaacataatcaaatgtattatcctttcctttatgatcaatgctatggtctatgtaataagcacttctcttcccagagttcatgaaaatcttctgttatgttatcttctctaacccttgttgctttgccttttgcagctagagctaccatatatctggattttgtttttgtatattaagttttctttgtgtccaccatctgttgatcaaccatcctattacatttgttgaaaggaccattcttcccctaccatcattaggcagtgccctctctgttctatttgtctgtctttctacactatttgctgtcgctttattgtaaatcttataactttattgtaaatcttgatgcctctggtggaccaaaatcttcccaccttattattctttttaaagaatattttgcctaactttggtcctatgcatctctatacaagctttagaatcagcttgatggactgcaatcaaaatacttgccagaatttgattaggattacattgaagcaaattggtttcagaaaaattaacatattttaaatattgagtcttttaatccatgaacatgtttgtctgtttctctttaatctatcacaataatgtctcatagttttctgcatagaagtcatgtacatcttttgttagattgttacctaggtatttgctgtcttttgatgctattaaaatgcatttttattttgctcttgcttgttatttttgtattgttggtctatagagttgcaaatgatttttatgtgttggctttgtaaccagcaaccttgttaaactctcttattcattttaacaatttatgccaggcacagtggctcatgcctgtaatctcagcactttgggaggccaaggtgggaggactgcttgagcccaggagttccagactggcctgaacaacatagtgagactcagtctctacaaaaaaaaaaaaaaaaaaaaattaagttagccaagcctggtggcacacggctgtggttccagctactttggaggctgagacgagaagatcacttgagccaaggaggtcgaggttgcagtgagctatgatcgtgccactgtgctccagcctgtgtgacacagcaagactctctgtctcaagaaaaaaaagaaatactagatttttcacctggttagatgattaaaaaacaaagaagaaagaaaaagaaaatgtaaaaagaaaaaattattagacatttttatattttcaatgaacatatatcagctacataatgagagtattatgccttttgtttcttttcctggccttagtcacattgttgaaaacctcagtgcagcgttaagtagaagtggagatagtgggaaacttgacaaaagtgtgtataatatttattatgtacggtatgatatttactagaaacttcctgtatctatcttaaatagactgaggacattttcttttattcccaggtggctaacagtctttttgtcatgaatggatgttgaattttatcaaatgcttttcccacagctactcagatggtcatatgatttttcttttctattcttttacatgaccatttaaatttatttttagcatattaagttaatcttacatccctgtgttaaagtccacttaatcgtagtgtgttatcttttttaatttaacactgaatttattttatttaggattttcacacctgtgaatgtgtgagtgtatgtgagactggcctgtaaatttcctttttcatgatgtccttgtctgattgatagcaaggttaccctgctctcataaaacaagttccctctttttctagtctctgagagaggtcttttcttttttgtaaaatgaactctttttttctcccttaaatgtttgttacaattaatcagagaagacattggaacctacagctttcatgtgggaagtttttaattatatactcaatgtatttaatagatatggaactattctgatctgttactttaattttagcttaattagttatatattttaggagttttttcttttcatctaaattttcaaagacccaacatctggctttgttgatcctctctgttcttgttttcaaataatttgtgctttattttattttttcttttcttttctttttttttttttttttttttcttgctagagacagggtcttgctccattgcccaggctggagtgcagtatcagaatctcagctcagtgcagctttgacatcctgggctcaagaaatcctcccaccccagcctccagagtagctgggactgggactacaaatgcataccaccttgtccagctaattgttatttactttcttctactttatttggaattaatttactggatatttttcttcctttttttttttttttttttttttcgagacagcctaggctgtcgtctaggctgctggagtacagtggcacaatgacagctcactgctgacttgacctccctgggctcaggtgatcctcccacctcagcctcctgagtagctaggaccacaggcatgcaccaccatgcccaactaattttgtattttttgtagagatggtggtgtggtttggccgtgtccccacccaaatctcatcttgaattgtagttcccatgatccctgtgtgtcatgggagggacccagtgggaggtaattgaatcatgggggcggttacctccatgctgctgttctcaggatagtcaatgagttctcacaagagctgatgcttttataaggggtttcccccccttttgctcagcacttcttcctgcccccatgtgaagaaggacttgtttgcttctccttccaccatgatcgtaagtttcctgaggcctgcccagccctgcggaactgtgagtcagttaaacctttttcctttataaattacgcagtctcgggtatttcttcatagtagcgtgagaacagactaacatagacgtggtctcactatgttgccagggctggtctcgaactccctgggctcaaacgatctacccacttcagcctccccaagtgttgggattacaggtgtgagccatctcaccctgcctcctttcgacttctcgagatgaatatttatctcactgatttttttggctcctcttcttttccattataaaaaatgtgaaactgaaatttgcccctaaaaatggctttagctgcttctcacagatttgatgtatgcttgtttttcctttttttctttttttttttttttcttttgagacggagtctcgctctgtcgcccaggctggagtgcagtggcgcgatctcagctcactgcaagctccgcctcccgggttcccgccattctcctgcctcagcctcgcgagtagctgggactacaggcgcccgccaccacgcccggctattttttgtatttttagtggagacggggtttcaccgtgttagccaggatggtctcgatctcctgacctcgtgatccgcccgcctcggcctcccaaagtgctgggattgacaggcctgagccaccgcgcccggccaacttgtttttctttctcactggagctggttccagattagatctggtcggacccggcaggcacctggcgggcactgtgcgggcagggaaccagggagagcaggagggcgcgggtccgggccaaggctggcgggggtcgccgcggcgcgaccgcctcctccgccccggctccgtgggatgcgcgtccgccctcccaggccccttcctcccgccctcccccgccccccgttttcctcccctcccctcccgacccgccccaggccagacccccgcgcgggtcctcgccctcccaggacccttcctccctcccctcccctccccgccgcgtcccggaccctgcgggctggtcccgcgccccgccagggctgccggggtgtgctgctggggagcgtggagtgggcaggaccacgctggacacgcagttcgcgtgcggccgctccccgagcagtgcgcggcgtgggcggaggagcggctccgcgaggagatcgaggcgaacgcggcgcccgcgttgctggaggtcgtggacgcggcgggcgccgagcacctggtcacgctccaggacctggacatccgccacggcgacggctccgcggtgctcccgggcgtgtgcagcgaggcctcgttccgggccgtgaggccgccgagcaagcgcctgcgccggccgtgggaacccggggccgtcccgcgggtgctggtgggcacccaggccgacccggacgacgggcgccaggtgctgacggcgcggggccgcgaggggcgctccccgttcccggaggtcatggccaagagccagcggatggtggaccgggtgttcatgcaggcggtgcgcgagacggaggccttggtcccgcccgaggaggaggtggagtgttgggaagttttctgttgtcccctggactccatccagaaaaagatggccctggtggcagcctcgaagcgcggggagggaggctaggactggggccgcgtcgggaactgagcctgccgggacgcttctaacccgcgcgctgcctcgagtccctccggtgcccaggccttgttccccaagacccacgggtgcagagcagaagcgcggccccagcgcccgaggcctgaaagctgttctttaccttcgcagctttccaagttactataataggtaaaaggcaagggctaacgtcttaagtatttaatcgatttccttatgcagattctgcactcgtaattactaaacgtgagagcccaggatgaactattcggtgcattttttatttttttgagactgtcgccaggctggagttcagtggcgatctcggtgatctcagctcactgcaacctccgcctccccggttcaagcgattatcctgcctcagcctcccaagtaggtgggactacaggcatgtgccaccacgcccggctaatttttgtatttttagtagagacggggtttcaccatgttggccaagatggtctcgatctcttgacctcgtgatccgcctgcctcggcctcccgaagtgctgggattacaggcgtgagccacggtgcctggcctattgggtgcatcttaaagcagcgatatacaggatagtaaatggaaacggaaacgactacttctgtattttaactaacaacagtgattcattctgttggcagtttttcttctttaaaagatgccttactgctttaagcctgaatgggcagaatgtgctttcttcaaatgcaatttgtggtatgtttttttgaactacctggttctgagaattacagtttggatttggagcacttcgccgaagtttagatcttagttccatgaagtttccatctcattttcagtgatgaattgagcaatcactttttcctttctgtgtggtcctaaatatagttacgacctacttagcacaaccttgcaattggatatgtgtcgctggcaaattaattttatacctaaagtgagcccagcgctggctgtcagttttgtaattaacatctggttgactatgctatgcacaggaaaatggagcacaaataaattgtttttaaactttgcaattcttaccatttgactttgtgaatcatatttaaagcactatgttccaagatttctagatgctgtcggatggctttaccattatttttcaggagtttgtttgttgtagagaaaactccaggaggtgagaggagagaaagcacccggttatgcagcaggcattgcacctgtgttattagcggcagctgccttcatactttgcctgaattcctggaatttttaaatagtgaaataggtatggaaacctatgaagaataggtcatctttttgttgatttttagcgcagcaacctttatccaattctttttttttttttttttttttttgagacttgctctgttgcctaggctggagtgcggtggcgcaatctcggctcactgcaacctccaccacccggattcaagcaattctcctgcctcggcctcctgagtagctgggattacaggtgcccgccaccatgcccagctaatttttctatttttagtagagacgaggttttcccgtgttggccaggctggtctcaaactcctgaccttgggtgatccacctgccttggcctcccaaagtgctgggattacaggtgtgtgtcaccacgcccagccctgataattgtttttaaacgcagtaagttttatgacattttggtttgggtgtttcttcgccttgggttggatagctgttctaggaaaaccaattactgcagctcactccggcaagggaggtggggggtgctgatcacatttccctgcctcaagggcaagttgtcctcaccaagctgctccctccctctgctggaaaggaagcaaaacaccagctgctttctgctgtgctctgggctgtgtggggaagtgcaggggcagcaaatggaaatcagcaacatcttgttcccagtcctgacacccctggccagcaagaccctgctgagccatgctggacaggatgggatgggcctcacgcagatgccacggctctaccctgctcggctgctggcttgtgggaatgctccgggagagctctgtggcctggtccctctggatctcagcctccatccaggaaaaagcaccccatattctctaaacaagccagctgctcctttgaactcctgacggcatcacaccctcccactcccatccagttgctcagcggtgagctggctgccagctgctggacaggccgaaggacagggcagtcaccttctgctcatgtgggcatctaagccacacccacccctttccccaacttacaccatctttccctctctctgtctctctctgtctctctgcctttgtctctgtctccccgcccagacacctccctgcctatgggtgcacgcacacaccagtggcaggccctgaaagtgcttcctcattgagtcaagatagtagatgggaagccatgccgggtgagagggcagagaatcgggccatcctcaaagacatgaagatgcatttctatttattcatctcccacagtataaaagaggctcatggcaatgagagtggacggccataaacttaaccaagtggtagcctcagtcacagccgctgcagcagaggtggcatctactggaagaggtccaccctggctggcgcttggcggacggccaaccgagctaaagaatgcaggccgggcgtggtggctcacgcctgtaatcccagcattttgggaggccgaggcgggcagatcacctgaggtcgggagtttgagaccagcccgaccaacatggagaaaccccatctttactaaaaatacaaaattagccaggcgtggtagcgcatacctgtaatcccagctactcgggaggctgaggccagagaatcgcttgaacccaggaggtggaggttgtggtgagctgagatcatagcgccattgcactccagcctgggtaacaagagcgaagagcaaaactccgtctcaaaaaaaaaaaaaaaaaaaaaagaatgcatccactcccactggggatggaggatggagggtgtctgcattcacctaggacagacagacgtgcacatttttgggttctctcttcccctaaacctcctgaggtaatctgtgaaaatgattcgctattcacttaacccggaaaaccccacaaaatcatgcaaagaggttcaaatcttcgtggtcaccttggaacacttgtgaaactgcccaggtcatcaggggtatgcatatatgaaaagccactaaggatctgaaagatgtcactttacagaagcagtgtgtgccattccaacgttacagtcagggagttggtaggtgtgcccaggccaagcagtggggctggacacaacgttggtggccccagaagagtgctgaatgcttgctgcatatgcttaacaatgcagagagcaatgctgaactgaagggtttaggtgtagattctctggtcattgagcacctccaagtgaacaaagcacctaagatgtgccaccagacctccagagctcatggtgggattaacccatacatgagctctccctgtcgcatcgaaatgatccttactgcgaaggaacaaattgttcctaaaccagaagattgcccacaagaaaaagatatccctgaggaaacaaaaacttatggcacaggaataaattcagcactaaaataaatgcaatgaagagttttttgttttttaaagtgcacttcgtgatcttgttaactaccctgctctcgatcacttcttctgaaggaactttaaggttcttgacactccacagaacagtgtgcgggctcctggtagtgaagacaccgtgttaacccatctgatggacaggaagtgctgctcccgtgcctggtgatggcaggaaaggagccgctgcagcaactgtggtcaccggaagcttggacccttcgaggataaaggtctgagccatcccagaaaccaacagcctagcccagctgcgttgccgtcccagagtaaggagggtctaaaatgagtggtgaggaaggaggtgagggacattactcacagccttgagatcagcgccagggtggagactgtacttagacttgtcccgccaaccccactgtgtatttttgtttagagagggtgcaaccagccaccgaggtgaagaatcagtcacaggacaaggtggatgcggggctgagtggatccgagtcgtgcaagcagcaggcacagagtgggcctcttgcctcgggagcctttgtctctgctgctggcattctctgggcagagctgcctgcttggccagggccggagagcttgcatccccaggaacagcccacaggaaccagtggccatgtaccccagtttcctgagccttggtggggcggttcagagggagatcctgacctgatgcttttgaatctcagcaaccctgaggccgaatcgctcctgctgttacttgatttggttgtgtaaaccaaaactaaaattctaagccacccgacggactgaatggacccacggacccccttcttggccaaagggactcaaagaaacctgaaaaattagttcagaccatgatgggaagggaggggtcagacacgcctcgttataagccctcctgcctttggagttcaggcacagctgaccagcattacattaaaacggagaccttaagatggacaaacagactctttgcagcaataagataccaaaattccaacctgactctaatatagtgtcacatgacagatagcagaccctgaaggaaatcaaagtatttaccccaaaatatgtttttgacatggtcctgcacagctgcctcttgtgggggaaatttgcctttttagagaaactctttcccttactgggtcttttccagagagcctgataatctttgaaaggtctcaacaggaagtatttgccatctattgcctctaagggcagccacctatgagactcatctacataataaaaaccttggtcttcacaaccccataccttatctgaacccagacattcctttctactgattccaggtctttaggcaataacttaactctttcaaccaattgccaatcagagcctttgaagccacctgtgatccataagtcccctgcttcaaattgtcctggctctccgacccaaccactgtatacctcatatgtattgaccgatgtcttctatctccctgaaactgaaacgtgtaaggccaagctgtagaccaaccccttggggcacgtgttctcaggagttcctgaggctgactcacaggtcatggctctcacatttggctctgaacaaatctcttcaaatatttcacagaatttggctttttctgtcaacagtggtgtgagcaattaagttcaaagggtagcaacaactctatccccttcagtttctctgaaacctcttttgcttctgtaataggaaatgtttatttgaaaacgcaaggaatgacgcacttgatgttgtgtatgttggagcaagctgatggcataaaatgaggagtggaggactatgtcccagggtctactagaatctgtgccctctaacctggaggaagattttcaggacccatacttggggtcgttctgtctttacagaacgtgtcccaggcgtgtatggaaacacactggaaacagagatcacctgtgtttaggctctgactatatagctagtcatgaaatttctcagtgatagggtatagatatatatgttcaaattctctaggaggctgggcacggtggctcaaacctgtaatcccagcactttgggaggccaaggcaggtggatcacctgaagtgagaagttggagaccagcctggccaagatggtgaaaccccgtctctactaaaaatacaaaattagccagttgtggtggcacacgcctgtagtcccagctactcaggaggctaaggcaggagaaccacttgaacccgggaggtggaggttgcagtgagccaagatcgcaccactgcactccagcctggacaaaaagagtgaaactctgtcctaaaaaaaataaaataaaattatctaggagacgccaagctgttctccaaagtattgttctaatttacacttttatcagcagcagaagaaagctcatcgctcttcatccctgccagtttactcttttctgacttaaaattcttgccaccctgatgggttggaaatgacatttcattttggttaatttgcatttcccttatcactaatgcagttgagcatctttttcattcatttatttgccatttgtgctatttctgtgcatctctgtttatttcttttgcccatttttctgtttggttttttatcatttttattgtgtcataggattcttaggaaagacaacatgtataaaaatgtgtatgtcttttgtcagttatatgtattacaaatatttttgcataagtgtacattcctttttgtaatgtagtcaaatgtatcaacgctttctgttacagtttgcatttttgccctattaaagatatcctttctctagaaccagaaataccattccacccagcaatcccattactgggtatatatgcaaagggttataaatcattctactataaagacacacgcacaggtatgtttattgcagcactatgtacaatagcgaagacttggaaccaacccaaatgcccatcagaagaatttggaggctacggtttctaaaggatggtttgacaggtggggcttaggaaatggagaatgctgattggttggttcaggggtgaaattgcagggtccagagctgtcttcttgctctgagtcaattcctgggtagagtcacaggactgggtgagtccatttctttgtatgggttatgggtttgggcggcaccagctggtgcctcagaatgcaagttctgaaaaatacctcaaacaccagtctttggttttatcctaatgatgtcatctatagaagcaactgaggaagttacaaacttgtgatctctggctacttgactccagaaccataattctaaccttgtggctaatttgttaactttacaaaggtggtttttgtccccaggcaaggagggggttcatttcaggaaggaaccgttatcatctttgttctaaagttaaactataaactaaatttctcccatagttagcttggtctacgcccaggaatgagcaaagatggttagcttgtgagggtagaagcaaaatggagccaactgtcaggtttctctcaccgtcataatttttgcaaaggtggttttaccactagtctctagtttacatggagctgatggtgacaagccatagcctggcaggggtggggggcagctgcaaactgtgttcctccttaacactcggcgttgtggcggctgtccagctccaattctggatccattatgtggcctccaccgagatgactggcctctctcagcctcagtttctccctcctcaggaaaacgagggtgataatgatagcgctttcctggggagcatgaggcaggcagcacaggcaaagctccatgcagaatcagcactcaattcagcgacggtggtggcaggaggggtgccatcctcactctgtgctgtgtggccctgggctccttaggcccctctggactttgtttcctcctgatgtatcaaacacagactcagcatcccgacaccagctcccaagagcgtccagggagtaggcaggggtgaggcagccctggggcccagggcatgtgaggttgtgctggggggagggcctggatgccctccctctctgtactcacggggacgctgtggcgaggtgaataagggcccccaaaggtatcagttcctaatccctggaacctgtgtacgttaccttatatggcaaagtctttgcagatgggattacattaaggattttaaagtgggaggggaccctggatcatccaggtgggccctaaatcacttgtatccttatgatgcaggtagagggtggcttgcacacagagcagagaaggcgatgtgaagatgaggcagagatcgggactacacagccaagagcaccagcagccgccgaatccggaggaggtggggaagaggcaggctctaccctagacccccaggagggagcgaagctctgccgaccccttgatttcagcccattgatactgattgcaggttctggcctctgaaaccgtgagagaagacttttttgttgctttaagccaccaagtttgtggtgacttgttatagcagacacaggacctaatacagacacatgctgttcccaggaaacaccgtggccacccccagggccaacacacacacacacacacacacacacacacatcccccagggcctggccagaagaaagaagccccgccctatggccccccatcacacacagacagatcccctctgtcctctgtaggcttggcgtgccccagggaatacccaagcctgacctgcagagggaaactgaggagctgggccaggcctcggggcatctcctggggctgctgcagtcctgagtgcacctccctggctcagccccgcccggggccgcaggggcagctccaccggcctcaaccctagcagcctcctcctgggtcccactgaccccaggctctaaacagcctgtggctgtggctgcctggagaacctggcgatggggggtgcagactcctcccttaccctggcttcgtccctccgtcagtcttgctgactcacagacgcttctgttcattctagagcaattaattgcatatctcttttagatactgcaattatcgttgccttttctcatatctctttccgatttgttcctggtgtccctggacaatagcatcttagtttcgatgtaatttacaatgattgtggccttatggattatgcatttgatacgacacttgatcttagccagaagcccgagaagcaatgggttaggcatttgaatcctggtataacaagaccttctctgcctgtatcttacaaaaattcttttacattttcttctagcttcctatttttacctttgacatttggaactttactttctctagagtcctgctttgtatgtgaggttaagtaaagatccattattttcccactaagttagagatccagtcttctacaccaggtgttcccaacacccaggctgtggaccagtaccagtccatggcctgttaggacccaggctgcacagcaagaggtgggtggcaggcgagtgagcattcccgcctgagctctgcctcctgtcaaatcagattctcataggagcacaaaccccattgtgaacttcacatgtgagggatataggttgagtgcttcttttgagaatctaatgcctgatgatctgaggtgggacagtttcatcctgaagccatcccccacaccctagcagtcatggaaaaaattgtcctccatgaaatcagtccctggtgccaaaaaggttggggactactgttctacaccattgcttaagaggctcactgctggccaggtgcagtggctcacgcctgtaatcccagcactttgggaggctaaggcaggtggatcatgaggccaggagttcaagaccagcctggccaagatggtgaaacaccgtctctactaaaaatacaaaaattagccgggcatggtggcaggcacctgtaatcccagctactcaggaggctgaggcaggagaatcacttgaacccgggaggtggaggttgcagtgagccaagatcacaccactgcactctagcctgggtgacagagcaagactccatcaaaaaaaaaaaaaaaaagactcattcgttggccaggcacagtggctcatatgtgtaatcccagcactttgggaggccgaggcaggtggatcacctgagattaggagttcgagaccaccctggccaatgtggtgaaatcccatctctactaaaaatacaaaattagccaggcaaggtggtgggtgcctgtaatcccagctactagggaggctgaggcaggagaatagcttgaacctgggaggcagaggttgcggtgagccaagattgtgccattgcactccagcctgggcaacgagagcgaaactccgtctcaaaaaaaaaaaaaaaaaagattcactccttgcccatggtgggatcgtgtgatattctcacaatgctcgccctgctccggccccaccccactctgcgggtggcttgctcctgttcccaaaagctgctcctccgaggacgcttcctagtgtgtcttcacatctgggattccgcgttttcagctggcttagctatttgtggctgtagtctttcctccatttttagagtatttactgagctcatcaaagaacctgagtggtatattgatagggaagactttgactttggatttgtagatgacttgggcaatattgtcaggattctgttgactcaccaggagcagggtgggcaccgcagcactctggttatgcagctggccttgtagggggtaagcccccaccagcaaagtgagtccgtgggagcggtagggtgttggggcacctgcacccctgaaccatctccctgagtgagaacatgcctctccaggatgctttcaccaccaggaactaaccaggtggtcttgagactggtgaactccgtggaccaaacagaatccaggctccaagcctctccctggcaagcctcttgccttttggttcatggcaggaagcaacacctcatgtcatgctgggactgcagcccaaggcaggaaagcaccagcctttcttaggaccccatgggtagcccccaacttcaccagcccctttcctgtgatgtctccacacatctctttggccagagtcctgtcacagcccagtcccacaacgtggacctgggaggggctccagggaggggtatggaggggatgagccctcttgtccaccccaaaagcctggtcacagtggggacagcagcaggtgcagtccagctctgcccatctcccagctagagcgggagggaggcaccacagggctcctctagtcctgaggaatgagcatcctctgtcctcccaaggcccagccaggccagctgatatgtgctgcccgggggccggggtgggagccaacaaactccccctgaccagccactgtccagtgggaagctctagccagaccgtgcttagatctaggcagcggctccccacagacacagggctccaagtagccacactccagagcctctccaggacttcgaagagtttcgcaaaagtctagggagagaaggagcaccaaagcctccttagtcacagcctctgggcctaatgcactcccttctgtggccaacctcacctaccctgtcacctcagactcagaaggagggccgcagagccacctggacctgagcttcaattctcttaaggctctaccagggtgacccttcagcggagaatccagagtgggggctgcatgtgaatgaagctcaatcatggggggctgcatctgaagctctcaagcaatggaggctggatctgaaactgtcaatcactgggggctgcatgtgaagctgtcaatcactgggggctgtatctgaagctctcaatcagtgggggctgctctggggctctcaatcaatggggctgcctctgaggctctcagtcaataggagctgcatctgagactcagtcaatagggcctgcatctgagactctcaatcaatgaggactgcatctaagactctcagtcaataggggctgcatctgagactcagtcaatgaggactgcatctgagagtcaatcaataggggttgtgtctgagacttaatcaatgggagctgcctctgagactctcaatcaatggaggctgcgtgtgaagctctcaatcaatgaggggtgcatccgggactctcaagcaacggggggtacatctgagactctcaagcaatgggggctgcacgtgaagctctcaatcaatgggggtgcatctgagacactcaagcaatgggggctgcatgtgaagctctcaatggaggctgcatctggggctctcaatcaatggaggctgattctgaagctctcaatcaatgggggccgcatctgaatctctcaatcaatggaggctgcatctgaagctgtcactcagtgggggctccatgtgaacctctcagtcaatgggggctgcatctgagactctcaatcaatgcgggctgcatttgagatttcaatcaataggggctgcatctgagagtaattcagggttgtgtctgagaatcagtgcggactgcctctgagactttcagtcattgggggctgcatcttagactttcaatcaacaggggctgcatctgagactttcaagcaatgggggctacacgtgaagctctcaatcaatgggggatgcatctgagactctcaaccagtggggggtgcatctgagacactcaagcaatgggggctgcatgtgaagctctcaatggaggctgcatctggggctctcaatcaatggaggctgattctgaagttttcaatcaatgggggccacatctgaatctctcaatcaatggaggctgcatctgaagctgtcactcagtgggggctccgtgtgaacctctcagtcaatgggggctgcatctgagactctctatcaatgggggctgcatctgagactatcaatgggggctgctctggagctctcaatggggcttcctctggggctctcagtctatggggctgcatctgagactgccaatcaatggaggctgcagttgagacttcaatcaataggggctgcatctgagagtcattgagggttgtgtctgggaatcagtggggactgcctctgagactctcagtcaatgggggctgcacctgagactttcaatcaacaggggctgcatctgagactcaatcaataggggctgcatctgagactctcgatcaatgggggctgcatctgagactctctatcagtggggctgcctctggggctctcagtctatgggggctgcatctgagagtcaatcaacaggggctgcatctgaaacttaatcaatgggagctgcctctgagactctcaatcaatggggactgcatgtgaagctctcaatcagtggaggctgcacctggggatctcaaccaataggggctgcatctgagactcaatcaatggggctgcatctgagactcaatcagtggaggccgcatctgagactctaatcaatggaggccgcatctgagactcaaaacggtgtgggagtgcacggcaaatctggcctttggtgccctctggtgggcattgcatgccctgctgaccagtctgaggacagagatgagggaaagaaatcagggtagcgtggggctgtccagggttttccccaccgacatggatgacagggtgaccctgaagaagtcactcttttctcttagccttggcttcctaatctgcaaagatggtgacagatacattccatttcaaaaggctgccagggtctaggcgcagctgctcatgcctgtaatatcaggtgcactttgggaggctgagggaggaggatcacttgagcccaggagtttaagaccagcctgggcaagatagtgagacccccatcgctacaaataaaataaaataaaataaaaattagctgggtgtgctggtgtgtgcttgtggacccaggtcctccggaggctgaggtgagaggatcacctgggccagggaggccaaggctgcggtgaaccatgattgtgccaccacactccagcctaggtggcagagtaagaccctatctttaaaacacaaacaaaaaacaaacaaacaaaactgccagggatgagatagttcaggcaagactgtgcaagtccacagccctggcagttccttcctgtgtctcccagacagaggggctgagttccagaagaagagggtttcaccgtcccgcgccctcccctccatcctgtgtctggctgccaggggatgttcctaagcccttcaggttcctgctggccataggacagtccccgagtgctctggcctggctctcgaggacggggatgccctgcctgtcccttccccagcctcagctgtgctgacaccttccatccccacacacacctatactgtgaccacctcctggcctttgcccctgctgacccccttggtcactccctcccgctgtccccttgccctctgacaaattcctatcttccttgtaatcccagtgtgggtgggcatcttctcctctgagaaccttcctggatcccactgctcacccccaccccgccccggcctcccctctccccggccccaccccgggtcttccctctccacagctccgccccagcctgcagtccactcgcgtcttgtcatatgagaccctgggtgtctcacatccgacacggctttaatttttatcttccttacatgttgttctcccttgttgaactaggagatcccctgaccttggttttcttccaggccccggagacgcctggcctgtgttgagaagggtacaagtgtgttgaaacctctgtccgactgaggcggcacatcagcagaaaggagccagggagcccagggacgcctgcgggcagtccctctgccctcctacccacacctgcttctgggcagccagtgttcatctctcggaggccatgggcctggggactgggttcaggtgagccatgctgcaggtgctccccacgcctcgcaaagctggcaggagaggactagcagcctgcactcccggtgcccaccccgggtccagctgggccagaactttttgttcagaagaaagccaaggctgttctttccagaatccatgttgaagggtttcctcttctcccgggactgcagctcacagggaccttccttcagttgtttaatttactctataagttatagcaaaaagaacattgattcaagacaatccccatcagagtctcagctggcttctttgtaggaattaagctgatcttaaaattcatgtagaaactcaaggaacccagacagccaaaaaaaaatcttgaaaaagagcaaagattggaggattcacactttctgatttcaaaatttactacaaagctacagtagtcaaacctgtgtgtgcttgtataaagacagacatatagacccatacaatagaactgagattccagaaagaaactcacatttaggggtcagttgattttgatgagagccaaggcactctcatcaaaatcaattgacccccaaatgtgagggtgaagtggggaaagaacagtcttttcttcagctgggagagcggagagccacctgcagaagaacgaagttggagctctacttcacatcatatacataaagtaaatgaaaatgtacaagaccctttcagtttaaagattataatctcgaatccacattataactaacctttaatccacattttaaccaatctttgattataactcatcttttaaagaatctttaaataatcatgataactaatctttaaacatctccagttttggtgtggtatcaaagaaggatagtcacaactatctaaagactgtattgaattactcatccttttccaacagcatgtctgtgagcggctgaatattccccacaaacttcaaccaaaacaacgtatcacaacagactcatgcagaagcagatatgagaatctacctgtctcctatcaagccagaccataaagatattgacaaaaatgaaaactaatgccacccttattgttaactttgttgttgtggtttcagaacatacttatttttcatttaaaaataatgactaatgttaacatgttatggctttgtcattcttttaaaataaatattatttctaaacaaatattctttttaaataaaaatttattttcaaatgtatctatgtatacagtcatgtgttgcttaacaacagggatacattttgagaggtgtcattaggcaatttcgtggctgcgtgaacatcatgacaaagacctagatgaggcagcctactacacacctgtacaacgtgggactgtactgaatactgtaggcaattgtgacacaatggtaagtattaatatttgtggatctaggccaggcatggtggctcacgcctgtaatcccagaactttgggaggccgaggcaggtggatcacctgaggtcaggagttcaagaccagcctggccaacatggtgaaaccccatctctactaaaaatacaaaaattagctggggatggtggtaggtgcctgtagtcccagctacttgggaggctgaggcaggagaatcgcttgaacccaggaggtggagattgcagtgagctgagatcataccactgcactccagcctgggtgacagggccagactctgtctcaaaaaaaaaaaagtatttgtgtatctaaacagatacaaacatagacaaggtacagtaaaagtatggcataaaaagtaaaaaatgacacacaggtttagggcacttaccatgaatggagcttgcaggactggaagtggctctgggtgagtcacaagtgggtggtgagtgaatgtgaaggcctaggacattactggccactactgtagactttgtaaacactgacacttaggccacactaagttcataaaaaatatttttctttctttgataacaaattagccttaacttactgtaatggtttaactttatataccttttactttttaaaaaacatttggactcttgtaataacacttagcttaaaacacacattgtacacctgtataaaaatattttctttcctttttttttttttttttaatttttgagacagagtttctgtcttgttgcccaggctgaagtgcaatggcgtgatctcggctcactgcaacctctgcctcccgggttcaagcgattctcctgactcagccacccaagtagctgggattacaggcatgcaccaccacgccctgctaattttgtatttttagtagagatggagtttctccctgttggtcaggttggtctcgaactcctgacctcgggagttctcccgcctcggcctcccaaagtgctgggattacaggtgtgagccactgtgcccagccatatattttttctttatatccttatcctataaactacatactgttttctgggttttttgtttgtttgtttgtttttgagatggagtctcactgtcgcccaggccagaatgcagtggtgcgatctcggctcactgaaacctccgcctcctgggttcaagcaattctcctgcctcagcctcccaagtagctgggattacaggcacgtgcaaccatgtcaggctaattttttttatttttagtagagacagggcttcaccatgttggccaggctggtctcaaacccctgacctcaggtgatccacccgccttggcctccgaaagtgctgggattacaggcgtgagcccccgttactccccgggcgctgttaagcggctttgcggcagcctcacacgtagccctcacaaccactagggacagcggcttctcactgctggctccaacccacagttaagaaacacgtgggtatttacaatacatgcccacaaatgcacaggcaatcacatttcccctgcacgccctggccccttcccacactttctcttccattctacttaggattgccagattgagcaatacaaatacaggacacctgctatttgaatttcaggtaaatactttttttttagtgtgttccaccccatagaatatttgggacatacacactttaaaaaagttacttatctgaaatgcagatatgactgggtatcctgtaattcacctggtaaccctagttctactccgtttttttaaaactgctggttgtaacccccaacccaatgttacagccttcagtgagtcccagcccccgcttccttaggccaggagacctggagtatcccattccacaggggaagccacagctgggaggaattcagcctcctccttccaaggcccacgggtgagcagattcggatgagcatctcaagggcctgcggatgccacaggaagaggtttaaagatgtttaaagatgacttctggccgggcgcagtggctcacgcttgtaatcccagcactttgggaggctgaggcgggcggatcacaaggtcaagagatcgagaccatcctggctaatgcggtgaaaccccgtctctcctaaaaatacaaaaaaaaaattagccgggcgtggttgtgggtgcctgtagtcccaggtactcgggaggctgaggcaggagaatggcgtgaacccgccaggcggagcttgcagtgagccgagatcacggcactgcactccagcctgggcgacagagcaagactctgtctcaaaaaaaaaaaaaaaaaagacttctgcaggccgggtgtgctggctcacacctataatcccagcacctcgggaggctgaggcgggaggatcacttggggtcaggagtttgagaccacctggcctacatggtgaaaccccgtctctactgcagaaattagccaagcatggtgctagacacctgtagtcccagctactgaggaggctgaggcaggagaatcgcttgaacccaggaggcggaggctgcagtgagccaaaaaaaaacagaaagaaagacttctgtgcacataaatgactagtggcagttacttcggttttaaaatatatatatttaaggtattaaagttctacacttaaaaacctagtttttccttaagtgttgaagatcagcttaaaaacctgaccatgctgtggataaatccagccagttctaacaactgtttacagaggggcttgtggtttacgttcagtctcatttacaagctggtttaaatgagaactcttaaaccttttaaattatatatttaattgcttcaaatactgcaattgaataacaaacaaaacattccctaggtctttggtccttaaacattggccacactccctttactaaattccttttagtttcaaactaaaatatcataggactaaattaaaatactcaattaggcattgcaaatccatgtccctttctaggtgggtttagttccctgtgggtcagagtcactgactgggagccaggcctggagctaaggacagccaccagatggctttttcatgacaaaaagggacaagttttatattctccataaagccaatagggggccaggtgtggtggctcaagcctctaatcccagcactttgggaggccaaggcaggaggatcactggaccccaggagttcaagaccagcatgagcaatgtagcaaaaccccatctctaccaaaaaaaaaaaattaaaaattagctgagtgtggtggtgcacgcctgtagtctcagctacttgggaggctacagtgggaggatcgcttgagcctggaagttagaggctgcagtgagctgtgatcacaccactgcactccagcctgggtgacagagtgagactgtctcaagaaacaaaaaaaaaaaaccctgtgtaaggctcctccacacagtgaagccttcctgacatgccctgcctgccccacaaaggaatccttcccttccccaccagacggattctggatcttgtgctctggacccctttgccaatgtagtaaaaactatagagcccttttcagggtaccatttatacagcataacataaaatacataaggttacaaatgaaaccaaatatattgaaaatattaccaagtgtttttaaaacagtaactgggtgatataatgatctttactgttattaggcaggtctatggctgatctaatagctgctatgggttcaaatggtgagcctcactgacacttctagatctgctacaactgaaacgcagcaggacaatgtctgtgatggtaacaaactcagggaccctgctaatactactctggtttgttgcctatgttcgtgattaaagaaaatgctagatttcaggtagaaattagtgagactaaagatacaagtttcccctgcactcatggaacccctgaattctgtcaacagaccccaggacaggaagctctgcaccatttccataccttctgtgagctctgttcttctctggatattccatctctccctggacgatggtgggggcgctcttgttaagaatgatggcaggaccggacgtggtggctcactcctggaatcccagcaattttggacattgaggcaggcccatcacttgaagtcaggaattcgagaccagcctggccaacatggtgaaaccccgtctctactaaaaatataaaaattagccaggcttggtggtaggcaactgtggtggcagctacttgggaggctgaggcaggagaatcgtttgaacctgggaggcggaggttgcactgagccgagattgcactgcactctagcctggatgacagagtgagattccatctcaaaaaaaaaaaaaaaaagaaagaaagaaaaaaaagaaagaaagaatgatggcaaccagcgtttgcagagggcttagtataggccaggtactacgaaaagcctttcatatgcattattttctccagtcctcccagcaactattagcttggtgcaaaagtaattgtggtttttggccaggcacggtggctcacacctgtaatcccacgactttgggaggctgaggcaggcagattgcttgaggtcaggagttcgagaccagcctggccaacacagtgaaaccctgtctctactaaaaatacaaaaattagccgggagtggtggcgcatgtctgtaatcccagctactggggaggctaaggcaggagaatcgcttcaacccaggattgcggtgagccgagatcatgccactgcactccagcctgggacacagagtgagatcctgtctcaaaaaaaaaaaaaaaaagcaaacaaaaaacaaaagcaattgcgttttttgccgttggaagtaatggcaaaaacaacgattacttttgcaccaacctaatagtaggctttggatgcaggttagtctgacattccattctgctgttcgtcaacaccaagccagtgtgtccacatgcctgcttctcccattagacagtagcccttcaacagcagggatgatcagagtcatcttggtgtgtgcagctaacacagatgcctggcacagaagaggcacttgctttccacctgctggctggtcacgaagacgatgcacacacatgcacagacatgagcacacaagcacacacaggagtggaccaggccgagtgtggggggacacacgcctaccctctttagagcccagccatgctgacctccaatcacacatcctattcactcgcctacttctgctgccacctaaccaaacttcctggctttcggtataaacaaatcctttctagagaaataaagcattcctagttcacttttgagaaaggtgagccccctggggaactgcagtgctgagaagtctggcgggaagggcacattcatgggacttgatgacagggagggactggctggatctgctttgagcacagtccaaccatctttatagttcatcacaaccagcctttaaaatgcttcgggaacatcaggatagtgatcaccagcagggcaccgagcacagggcgtaaagggggcttctgagagggggtgtgatgttctgtttcccgatgtgggtgccagttcctccaaagtggtcggtgtatgagtggtcatggggccacacttaggtacctgcggttctctgtatgtatttcatattccaatacaaagctccaaaaattgcttcagaagtcagttaagcttctcttcctccagattccaaactcatatgccaaaagttcatttctctgcaggccaaaatggagcagccttttataaacaggcttcctagagttttgccccaaaatattcctgtatcccagcagcaagcaccctgatgcccacccagtggtctgtatctgtgtcaaccagcggttctcagcctggcctcatccagggcctgaagcctactacagaacccccagcagcacgtggggtgcacagcaaagatcagccctggacacagccgggtgctcagggcggggtgagggggcaggaggcaggacgcaggaggtgagctgtccgggcggggcaggatgagggagtcctgcattgcagagctaagggggagaatcatcagcaccctaattagctcttgatggcttccaaagccttttaagtcctttttttttttttttttttttatccctacaagaactctgagtggtaaacaggacaagtaacataattcccaggatacaggtaaggacactaaagcccaacccaaactggtgggtagcaaggccaggcccaaacccagagctctgggctctaagccagcacctactccccaacacagaaaggaggtgggagcagccgggccctagccaaccactcccggccccttggcagatcaggcagagtgagggcacaggagggagagaagacctctatgcagaccagtgcagccaggcaggggtgaggagcccctgccaccaccaccaaagacaaaactgagcctcgatccaatgcagactccaggaaatatggggcaggtccatgaccttgtgagaagggaatcagtcaaatccaaaatgtgggacatgtacgggacaactgacccagtttctttaatgagtcaatggcattaaactaaggaggggtgacagttctaaattaaaagacactttcaaaggacctcaagacggcagtgcataccgtgagcagatcttatttagatcctgatttaagtaactcaactataaaaagacgtttttttgaacagagcaatttaatttggtacttggtacatttaatgtggcagttggatattcaatgatattaatcttcaatttaccagcagggtccagtgagttcttttttttttttttttttttttttttggagacagagtttcactcttgttgccctggctggagcgcagtggcacaatcttggctcactgcaacctctgcctcccaggttcaagtgattctcctgcctcagcctcctgagtagctgggattacaggcatgcaacaccacactcagctaatttttttgtatttttagtagaagtggagtttcaccctattggtcaggctggtcttgaactcctgacctcaagtgatctgcccgcctcagcctcccaaagtgctgggattataggcgtgagccaccactcctggcctatttttatttttttagtttactttttgagtagttctagcactgtataaggattaatagtttgtgaattttattctgtcttagagaccttctacagaacaaaacccattctgtcttgcaattcctacagggattggttcaagccttttgtaaatctaagatatattttggaatcaggaatcttatttttcctgtatcttgaaatatttttctatttcatcatcctgagaattatttcatcatcactcatttaagtatttccagttatgctaaaagagactaaaataacaaaaaaatgaaaagctgatgcacttgcctaaaaagcagaatgaaataaaccatctctgccacagtatccttccgttttctcactacattgctaacagtattgcatcaactttcaagaaggtagaagataattctggagatgacaggctttcctttgtttcactcttattgaacaatacaatcaagcattctgaatttttcatttttcacccataacagcaaggagaagaaagttgactgagggagacattcataattataggcaattagaagcgggggaaggcccaacacagtggctcatgcctgtaattccagcactttgggaggctgaggtgggcggatcacttgaggccaggagtttgagaccagcctggccaacatggccaaacccatctctacttaaaatacaaaaatgagccaggcgtgatggtgaatgcctgtaatcccagctacttgggaggctgaggtgggaggattgcttgaacctgggaggcagaggttgtggtgagctgaaatcacaccactgcactccagcctaggagacacagcaagcctccatctcaaaaaaaaagaaagaaaagaagaagaagaagaagaagcagctaggggaaggccaagctccatggctcaggcctgtaatccagcactttgggaggctggggtgggtgggttgcttgagcctaggagttcgagaccagcctgggcaacatgacaaaaccccacctcaaaaaaaaaaaaaaaagaaagaaaggaaggaagaaaggaaggaaggaaaagaaaaattgtccaggtgtggtggtgcatgcctgtagtcccagatactccagaggctgaggtgggaggattgcctgagcctgggagctagaggctacagtgagctatgatcacaccactgcactccagcctgggtgacagagcaagaccctgtctctttaaaagaaaaaaatatatatatatatggtagaagggacagacagccactctgtcccattagccagaggctaatgatgatggtgaaatcaatcaaatgggataaatttcagtgagcattcagatgaccatatcccagacaaattttctcaaatccatatttctaatgacacaaaaaatttgcattcaattaacaggcaagacttcactcaatattttgtaataagaacttggaccactgcattttttctaaaaggatgtatgatggtatactttcacattttttgatgtttgtgaacaaaatgggatacatttcataagtggacaaatgccaaaagcaggtgtttatacaaagatactgagaggaaatagataatgcaaaattttaaattaattgatcattctaatgggtgtttatagatcaaaaaatgaaaatgttttgcaatcatggaacaaagaaaatggccacactgtctccaacaaaattgtaagtgtcaacgatttcaaaaagttcatccaaatatcacattttgacaacatcagtgcaagaagaaggaaaagtaatgttagcttagacacccctagaagtgcagttgaaacctggaattagcacttttaaggtggatgagttccaggctcatgcaaggcaggtgataagtagccagttgcattcaaaggatgctaccaatataccttcaaaatcacaaacatggaataaaaagttcagtttgctatgtcttcattctaaaatgtctaatgaagttgtatttcaccatccctttattcttacttctgcaaatgaccaacagggacgcctcagagatactgcaggttctgttccagaccactcaataaagctaatactacaagaaagtgagtcacagtttcccagtgcatatagaagttatgcttacgttatagtatagtctatttatagtctattaagtgtgcaatagcattgtgtctaaaaaaacaaagtacataccttaatttaaatatttttatttctggctgggtgcagtggctcacacctataatcccagcattttgagaggctgaggcaggaggatcatttgaggccaggagtttgagaccagcctggcaacacagagagatcacatctttatatatatatatataattgctaaaaaacatgcagacaatcacatgaacattcagtgagtggtaatcatcttgccggtgggggtcttggctcaatgttgatggctgctgactgatcagggtggtggctgctgaaggttggggtggccatggcaatttcttaaaataagacagcaacgaagttggctgcataaagtgactcttcctttcataaaaaaatttctctgcagcatacaatgctgttcgatagcattttatccaccgtagaacttctttgaaaattggagtccattctctcataccctgccactgctttatcaactgaatttatgtaatatcctaaatcctgtgcagtcatttcaacaatgttcacagcatcatcactaggagtagtttccatctaaagaaaccactctcttcgctcattcataagaagcaactcctcatctgttcaaagttttctcatgagattatagcaattcagtcacatcctcaggcgtcatttctaattccagttctcttgctatttccaccacatctacagctctttcctccactgaagtctcaaacccctcaaagtcatccatgaggttggaatcaacttcttccaaacttttgtcaatgttggctgggcgcagtggctcatgcctataatcccagcattacaggaggccgaggtaggtggatcacttgagctcaggggttcgagaccagcccagccaaaaaatacagaaatacaaaaattagccaggtgtgatgataggcacctgtagctactcgggatgctgagcttggagaatcatttgagccagggaggaggaggttgcagtgaactgagattgcgctgttgcactccagcataggcaatgggaatgaaaccctgtctcaaacaaaacaaacaaacaaacaaacaaaaaacccaatcaaactcttgtcaatgtttgttgatattttgacttcttcccatgaatcacaaatcttcttcatggcatctagaatggtgaatcctttccagaagtttttcagttgactttgcccagatccaccagaggaatcactatctattgccttatgaaatgtatttcttaaataacaagacttgaaagtcaaaatcactctttgcagagtggacgttgtgtgaggaggcatgaaaacaatattaatccccttgtacatctccatcagagcttttgggtgacgaggtgcatcgtctatgagcagtaatattttgaaataatttttttttttttctgagcagtaggtcttaccaatggacttaaaatattcagaaaaccacactgcaaacagatgtgctgtcatccgggctttattgttctatttatagagcagaggtagagtcaatttagcatattctttttgtttgtttgtttattttgagatggagtctcactctgtcacccagtctcgagtgcagtggcacaatctcagctcactgcaacctccacctcccgggttcaagcaattcttctgcttctgcctccccagtagctggaactacaggcacgtgccaccacacctggctaattttttttgtatttttagtagagatggggtttcaccatattggccaggctggtctcaaactcctgacctcatgatccacccacctcagcctcccaacgtgctagaattactggcgtgagccaccacgactggacatttttttggagggggggtcggggggctatggggtcttgctctgttacccaggctttaatgcagtgacacaatctcaggtcactgcagcctctgcctcccaggttcaagaaattctcccacctcagcctcccgagtacctgggattacaggggtgcaccatcatgcctggctaatttttgcatttttagtagagatggggcttcgctatgttggccaggctggtcttgaactcctgatctcaagtgatctgcccacttcggcctcccaaagtgctgggattacaggcgtgagccaccacgcccggccaatttagcatattcttaagtgtcctaggattttctgaatggtaaacaagcactggcttccatgtaaagtcaccagctgcattagccactaacaagagagtcagcctgtgctttgaagctctgaagccagacattgacttctcctctctagctatgaaagccctctttctatgaaccaacctctggtggctttcaacttttcttctgcatctccctcacctctctcagccttcacagaattgaagagagtgagggccatgctctggatgaggctttggcttaagggaatgttgtgtttggtttgatctatccagactccaactccctccatagcagcagtgagggtgtttcactttctcatcatccatgtgttcaccggagtagcacatttaaatttccttcaagaactattcctttgtgttcacaacttggctgtctgtcgcaagagacctagcttttggcctatcttggcttaaggaggcctgaggagttggagagagatgggggagcggccggtctgaggagcactcagaacacacaacgtttatccattaagttcactatctcagaagaacacggtttgtggtcccccaaaacagtgatgatggtaacatcacagatcatcgtaacagatataattctaatgaaaaagttggaaatactgtaagaattagcaaaacgtgacaagacagacatgaagtgagcacatgttgttggggaaaaaatgatagatttgctcacagaccttgaatttgtttaaacattaaaacaatatctgcaagatgcaattaagtgaaatgcaatcaaatgaggtttgcctgtatttctaaaatgacttaaacgttgaaaatgtaaagggtcctttggacccacagagccagtggtgacgctgagggggaagcaattgctgtcgatgctgtaaggtgtaacaggggccctttagttacttaagaaaatgaccttggccaggcgtggtggctcatgcctgtaatcctagcactttgggaggctgaggcaggaagatccctggagtccaggagtatgagaccagcttgggcaacatagggaggccctgtctcttaaaaagaaagagaggaaagaaggaaggaaggaaggaaaggagggagggagggagagagagagagaaggaaagaaagaaagaaagaaagagagagagagagagaaagaaagaaagaaagaaagaaagaaagaaagaaagaaagaaagaaagaaagaaagggaaaatgaccttctttgggctgggcgtggtggctcatgcctgtaatctcaggactttggaaggccgaggtgggaggattgtttgacctcaggagtttgaaaccagcctgggcaacatagcaaaaccttgtctctactaataatacaaaaattagcgaagcacagtggcaagtgcctgtagtcgcagctacacaagaggctgaggtggaaggatcacttaagactgggaggtagaggctgcaatgagccatgatcatgccaccatgctccagcctcagtgacagagtaagatcctctcttgaaagaaaaagagagagagaaagaaagaggaagggaggaagggagggaggaagggagggagggaaggagggagggaaggagggaaggaaggaaggaaggagagagagagagagagaaagaaagaaagaagaaagagagagaaagaaagaagagagagagaaagaacagaaagaaaagagaaagaaagaaagaagaaagaaagaaaaaagaaagaagaaagaaaaaagagagaaagaggaagggagggaggaagggaaggaaggaaagaaggaaggaaggaaagaaggaaggaaggaaagaaggaaggaaggaaggaaggaaggaaggaaggaaggaaggaaggaaggagggaaggaaaataaatgaccaggatgctttgttgagatgctgggcaaagcgagggtggctggcaaggccgagtggttgccgtgagtgctgctgtttgctctgctcctgtgaatgtcggacctctccataatacttttcttcagaaacgagaacaggagaatgcttcagcaatgcagctgtcactctgcacaactgggagtgcaaatgacatgccctagtcaggccctggcatggaacgtgtccacctccacactgggaatagcagaagccccaccggccggtctatcctggctgccccagagcctgagacccagtcctagcccagcaggtggtccagagggagaggagctcaggcccccagggaggctccaaggcgggtcttatcaacaccactcagtcaaccggccttgagaaggtcagtctgagggtagatggaatcccagctcctgtccatcaaggcacaggccttgatcttaggacaactactggtggggggctgttccctccccagcacagcagctgacaaatggggatcccagcaaaaactgccagaatccctgaagttaaagctccatcagtgccatgtttttgggtacctccttccccaggcaatggcagcagaaaagtttgtgagaaaccaaggctggcaggtgcccaagaaggccaagagtggatgccataggaaggctggggaagccatggaaggcactgccttctctgccaggccaccacagtggtccccagggccaggcttgatgacaggcccctacatgcccttacccagctccagccagggtgccggggggtcaggcaacccatccaggccggtctccttcacagctctgcccagagtctctccaagatgtgcagctgctttctaagctgaaacgtctcctggtccagtggggcccactagcacaaccagctcgtcctggttttagcagcgaaagccctgtgtgctcatcctggggcctgcttgcccatcatttaaataaccaaggaaggctgggtgtggtggctcacgcctgtaatcccagcactttgggaggccaaggtgggcgggtcacttgaggtcaggagtttgagaccagcctgggcaacatggtgaaaccccatctctactaaaaatacaaaaattagcctggtgtggtgctgcacgcctgtaatcccagctatttgggaggctgaggcacgagaatcgcttaaacccaggagataaaggttgcagtgagccgagatcacaccactgcactccagcctgggtgacagagtgagaccctgtctcaaataaataaataaatagataaatagataaataaataaataaataaccaagggaggctgacccaagcaattcttcccaacattcttctagcctttcctgatcactcttgaaaactgctggaaaattctctaccttaagaacgctgggaaaatctatctccacactccccctgccccatacatacccacatatggatggagcctctctgaaggcttctcaagcttttgactgtgaccccactataagaaataggtttacattattgcccagtgcgcacacacaagtacacacacacatgcacacactcaggagtcataatagtaagtacttagagacaatgataacagagacaggttggagtcaaataaccaacccttctcaccagggacccaggaatagatgcggcagcccctcgccgcagcctccgcctggggacagcttttctgggggaaggcctcagggcagaatgcagcctccaccttcccagggctcagcttgggggtcagtgggaaaagtcagaaagcaaagatgcagggccagcctctattccccaatcaggaagaaacaccgagagggagaagcctctgcccgagacaggaggccccggctgttttgtgggctgtgccaggagcatccggtttccagccttggttcccaggagtggtttctcctcccagggcccctctggcctcatctacaaaataacctgcaacaccgtggcaccactaagcgctgtcttcagattcggagagtttacaaagatcgttctctccctcacttattctacaaatctttgttatgttacccaaaaacatcagacactgagccaagcactagagcttaaaaagacaaagaagtcacagtcccagagcccacagagtctcagagcccagcccagaggcacgggctccccgacccaacacgctgcacacggatccatatgtgcgcctgtgtgttggggacgggggtgtgggcagggcacagagctgctcatggtggccaggtcccctgtgctacaagtaaggcagctcctgccattgccacctcgtcctctagagaagcctttccacgagccacgctgtggtgttgccttttccccggatggtccacggaggttgcaatgctcaattaacacgctctgagaatggaagtgacagtgtagcacaaagcagaggtgacacgcgtgagctcacggccgggtcccctccagcgtccaccccccaagaagtcccccgctgtctgggccaccagtttcattcagcaaatactattctataaacagctgacccagattctccgcttgaattaggacgtttcccaggcagttgaggatgtacagggatgaatttcaatgttgcttaaaagcattaaagcttgaaggcacactcaggccactcttccatggggacaatgctgctggcaccatccgaaggccacagcccccaggcagccaggaccctcccagcgcctctctcgctcagggttgactcaaggaacctctgcggaaagaggcgttttaaactttaattaacctacgttcttccctacgcctcgtgacctgactttccatcctctctccaaagggacctgcagcagcaatacagtcacattccattttaaccccaacgcccgtcaaacgtggcttggcccccagagcaaaagacaggagcatcagcaagtagggaggaagcggggacagacgcacaggccagggccacaatccccttgaccctccatgcatcctcacggaggcaaggtgagggagaggtccagctgttcacgctgggggagtgtggaggctgtgagaatgcacctccctcaccccccacagccccaggaagtgtcatcggccctggtcccaggtgctgggctctgaaatccatgttcccccaggctgctcccagccagtggtctggcacggcaagggtaccgaggcaggcccattcccaggggacaggagatttgccaatggccctgtgggccctttcctcagggccggacctgcagcacagatccatagccctccccagctccttctaggagggcccaggttaacaaacagaccagccaccgacaccacagctcatgccgccgccattcctcacccagtggtggcacaggcgtcccagctggcagcccctgacaccctggcccccaggctccatcctccatgcagcgaccagaccaacccttcgaaaacatgaatatgaggccaggtgtggtgtaatcccagcactttgggaggccaaagtgggaggagagcttgagcccaggagtttgagatcaacctaggcaaccagagtgagaccttgtcgcaacaaaataaagtttttttaaaaaagtaagttaaattaaatgattacaaagacttgtgaccgaaaggctcacagagcaccaaaaagaagacccacgcccgcagactaagaggaaaagaaaatctaaacagccaagaccaagtggagaaatctatgtctgaaacaatacagaagtaaaagaccagaagttgttagtacaagaggaatcagggcatcctgggagaccaaaggatgcgggcagctggtgtgtctgtgtctgctcaggagagcacacagaagttaattcagaaaacagacagcattgaaaagaaatacagggccgggcatggtggctcacacctgtaatcccagcactttgggagtctgaggcaggcagatcacgaggtcaggagatggtgcccatcctggccagcatggtgaaaccccatctctactaaaaatacaaaaattagctgggcgtggtgccgcatgcctgtaatcccagctactcgggaggcccagccaggggaatcgcttgaacccaggagtcggaggttgcagtgagctgagatcatgccactgcactccagcctgggcaacagagcaagactctgtctcaaaaaaagaaaaaaggctgggcgcagtggttcacacctgtaatcccagcactttgggaggcggaggcgggtggatcacgaggtcaggagatcaagaccatcttggctaacatggtgaaaccccgtctctactaaaaatacaaaaataaaaaaattagccaggcgtggtggcgggcgcctgtagtcccagctactcgggaggctgaggcaggagaatggcgtgaacccaggaagcggaacttgcagtgagcggagatcgcgccactgcactccagcctgggtgacagagcaagactccgtctcaaaaaaaaaaaaaaaaaaaaagagaagagaaaagaaatacagaaaaagtgggaccaactgatgtaacagattaaaatggtagaaacgggtctaaatagatcaacaattacaatgaaagaaagtggactaaatctatcagtcaaatgacagacacagatgctgtggatttttaaaaacatcatgacacacacagtttcccaaagacacacataaagcctaaggacacacagaggtggaaacaaaaggcggaagtgatgaagccgtgaatgcttgccaagggatgatatgatcagctgaaagagactctgagacaaagcttcattggggatagagatggccactaagtaagataaaaggttcgattcaccctgatgacaaagcgattttaaacctaagtgcccctgacagagtggcctcgaaaaccatgacatgcacagagaaacaggcgagcaccgatcttactggggggggtctcaacacatccctcaatatattgatcgttcaaatatcaacagaaaagcagcaagggctgagatctgaaactcagtcaacaacgtgcatatagtgttttgcagcccaagaagaaaaaatgctcacaggggccattttcggaaatctgtcacggactacccctggccacaagaaagggcttccgtgcccttcaaagaccaggtctcccccagaccatgagcctggaccaagcacacgaagacaagatgttcccaacaaaagggagagattttaaaagaagatctcgcatgtttgttttggatagcataaaacaccactaagtcattcacgggttaaagaaaaatatcagagtggaaatacctataacatagttggaattctggaaggaaattggcaatggctaagttttctagaattgagaaaagaaagatattggcatccagcttcagagagcccagctcttgctctcgggaaatgaggcagaaacaagactcggtaccaaacatgtgaggccaggaaacagaacagcaagtggaacctacaagtgtgccctataggtcctgagagtgagagcccccaggtggtgagtggggcagctgggcagccaggggtcagacgtctgtttacacacagacacacacgacaacacgcacacaaggaaccgcccctcctgctccgttctctggcatgcacggccttgatatctgtttttcaggttgactggagattgttggccacatttgccaagaaaagataagcaatcctcaccacgggctcacccatggtgcacagaactcccagcccggagatccagccacttctgagaacagaatcaacagccacttagaaggctcagcctaggctgggcatagtgggtcatgcctgtaatcccaatactttgggaggcagaggatcacttgagcccaggagttcaagaccagcctgggcaacatggtgaaagcccctctctacaaaaaaaaaaaaaaagccaggcatgatggcctgcacctgtggtcccagctactcgggagggggagatgggaggatcgcttgagcccaggaggtcaaggctgcagtgagccgagatcaaactgaaccactgcactccagcccgggaaacaggaaaataccctgcctcaaaaaaaaaaaaaaaaaaaaaaaagaagaagaagagaagaaaagaaaaagaaaatgaaaatgaaaaaggaaaagaaggcccagtctaggtgcaacttaagcccaccagcatccttcgaaccatagcagatcaaattaaaacaagccattggcccaattctaactttcttatgggcaaaatggaaaaacgtctggcctgagaaggaaatgccatgttactcctagggtgggctgattaagtcactcttcccatccggggccagagcaggatccgtcaggactcagcttgttgtgaaatgaggcctttcctggaaatgctgttcatagaacgcgacgaagcagccgtgacataagagcttggcattttgctgtgtacaaatccagacctttcaacaggatgttggggtggccagcctgctctttggaaacacggggctggcagaggctgcccctgcccctcgtccttggcccagcactatattgtctttgtgtcatggacagagaccaacacttctcctacgtcccctcctacttggagttaatcccagcccagccagtgcaggggagacaggtgtcgccacagaatcacagtggctccactctctgccctcctgagcctctgggcagtcccacactgccaggtcatctgcccaggagccttcccagaccccgggccccctctccttcatctgtatccaggcacgtgcctcgtgacagaagccttcccagaccccggccccctctccttcatctgcatccaggcatcagcctcgtgacatctctttgggtttcaggctaatattaaatacactaatcatggtgtggaaagagtttctgggtcaacaataaccaaaggcacacagagacaaggattcgaggcaggcaccgcgctgtgtccgtctgtcctccacctctccacccctgggtacttcaggggccccctcacagactacggggtcctagggggcaggacagtggccagtttacctgggatttcccagcagggcctggcctgaggctgatggcgctcagagactgttcgggatgagcaagccggtgcctccctgtacctctacatctgctcagctccccgccgccagcctgactggggcctccttccttgggctggcagactgctggcctcccctagtccccccacgggcctggcaaagggcagcctgcccagagcactgtccccagggccaccactcagagccctggggtgctcacttccaccatggtttttgcttgtttgttttgtttcgtttgagacagagtctcgctctgtcgcccaggctggggtgcaatggcacgatcttggctcactgcaacctccacctcccaggttcaagcgattctcctgcctcagcttcctgagtagctgggattacaggtacccgcctccatgcccagataatttttgtatttttagtagagacagggttttgccatgttggccaggctggtctcaaactcctgacctcaggtgatctgttcatctcagcctcccagagttctgggatgacaggcgtgagccaccacgcctggccccaccatggtttaaagtcttcttcttcccgtgccacagagtccttgtgccgcgaggcccaatcactccccaacatctgtacgtcggacttggacaccccaccttcacgcccaccccaacttcacgcccagccaccttcacgccccgcctctgcagcccctgtcccgcctctggcacgcctcccactccaggagccttcacaagcgctgctccctctgcctggaaaggctttcctattctcccatccaagtactaaccaggcccgaccctgctgagcttccgagatcagaggagatggggtgcgctcaggatagtatggccatagacaaccctcccctattctgttcatctggccgcttcctgctcagcatttggggcttcatttaactggcagcttccttaaggaggccttccctgacccccttcccttcccattcaccccggcccacaatgcacattgattccctgaactcagggtactcctgaagtaccaatcatcacgttgcatcataattgttggtttccttggaggcacagggtcaggctccgcatgggcaggagaagtcttcagggtgtgtttgctggattaacgacaggtcgatgccaatacaggacacccctgcaggtgaggatccccctcctcaatctgatcctgagaagacgccttctccggccctttggtcccacccaccctgactctcccaggtgaaaagcagctgttggtgatatttgcatgactgtgccagctggaacttttactgtagggccgtttcctaagatcatttcctaagactctctcaccactctgatggggacaggaaactgctctgggcacagcacttgtgcgatctccagccacaaaaagccgttaatctggccaagagcagaggcttgcgggtgaagggagtggaggggctgctgaagatggagatggtgcttagttttttttgtgggtagaagagtgcagagaggcccctgctcatcccaggagaatgaagtaggctttttgttctaaagggccaggtctctaaaagcaacggattatattgttcaggctgcgtcagtggtgtttgtgttttcaaaagcaatagtgggacgggcgcagtggctcatgcctgtaatcctagcactttgggaggccgaggtgggtagatcatttgaggtcaggagttcaagaccagcctggctaacatggtgaaaccccatctctactaaaaatacaaaaattagccaggcatgatggcgggcacctgtagtcccaggtacttgggaggctgagacaggagaatctcttgaacccaggaggtggaggttgcagtgagccgagattgcaccactgcccttcagcctgggcgacagagtaagactctgtctcaaaaaaaaaaaaaaaaaagcaagagcagaaagctaccaggcagttgcagggggctccctaaagccagcttataaccaggaaccaaaaatagggcttggcacgaggaggggaagaggggtgtgtgtctcaatgaggggaatggcaacatctctttgtgctctacaggtttaaaaaacaaaatggccaaggctctccccaggtgtcgatggggtgggaggcatggcccaactcctgaagatgtcatggcacagtgggcagccaccatggggaatccggccgggatgacagagacagccctgcagcacggcactgctcatagtggggccaggccctggaggagtctcctgaagccacaaacatacatagtccgcaccctcccctgccccaaactcagcgtgtagcagatcaacctctgtactatcagccaagccaatacaacaagcacagtgattgtggactactccccaagaacaaaacatcgaagaacagccaagctagcacgctggctcacgcctgtaatcctagcacttttcaaggccgaggcaggcggatcccttgagcccaggagttcgagaccagccttggcaacatgatgaaaccctgtttctacaaaaggcacaaaaattagctaggcgttgtgggaggatcacttgagccaaggaggtagagtttgcagtgagccttgatcgcaccctgaactccagcatgggtaacagagcaagaccctgtctctaataaataaataaatgaaaataacagccattcatcagaacagccattcatcagaacagccattcatcccggctctcagcacctccaatctgcaccctgtactggtcagcccaagctattctagagagtgctaccccacaagtctccctaagcagtctgaccataattacagctaaagataggtgcctctgatacttcatatactgtgccaggggaatcccacaatttactcacctggcactggcaccaaccctcccagacgggcaccataactgcccccatcccactgctgaaaaacaggcatagagagactaagtaagtgctggggtttactcatccagtaagcaggagcacaggttcagaccccaacccctcctcacagccttccagggctccaccccgcccatggtctcaccacccttccggtcactgccacccacctgccccctcccgggcatcctccacactcctcactgtcccctcaatccctcccccaatactcttggcctctgttgggttttctcccttctttccctatcttccagggtacctgaccccaaaaagcccttccaggctctccctaacctgatgtgcctcttcatcccttgaactcccaaagtctctctcaatcttttgtcaccacaactcacagttagggaagaattttgcatgacaaacagcacacacattcaaatatgtaactgaaacagaacgtttcccagaacgatactgtacttaccgtcaccagatgcaaagcaccctgacctactctgtgctgcttttatttttaaaaatgttttgctgcatagaatgtgcgacaccaagagtgagcccgaatgtagcatggaccaggtggttacaatgtgtccatgttgggtcatcaggggcaatcaatgcgttacccagggagacgctgataacagggcaggctctgcatgttgggggtgctgggggcacttgggatagtttgtatcttcctctcaattttgctatgaacctggaactgctctaaactgctctaaaaaataagatcttttttgttttttgagacagagtttcactcttgttgcccaggctggagtacaatggcaggatctcggctcactgcaacctctgcctcccgggttcaagtgattctcctgcctcagcctccccagtagctgggattacaggcaccctccaccatacccggctgatttttgtatttttagtagagacgggggttttgccatgtaggccaggctggtcttgaactcctgacctcaagtgatccacccacctcaacctgccaaagtgctgggattacaggtgtaagccaccgcacctggccaataaatttttttaagagatagggtcttgccctattgcccaggctaaagctgggctgttgcccatttcctccgtacttcctgatgctcctgtcttttgctctgggggccaggccaagtgcagctcactgcagccttgatctccaaggctcaagagatcctcttgcctcaacctcccaagtagctgggactacaggcacacaacaccatgcctggctaatttttgtgttttttgtagaggtgaggtttcactatgttgaccaggctggtcttgagcttctgggctgaagcaatcctcctgcctctgcctcccaaagtgctggattacaggtgtgagccgctgcgcctggccaaaaaaaaatttaaatgctcctctggccccactaaattgattgtacatcttggctgctccctgcagtgtggacattccctagagaacttgatcattcttttgggcaagttttttattttctcattccactttatttatttatttttatttgtatttttatttttttttgagacagagtcttactctgttacccaggctggagtgcagtctccagctctccagtgcgatctcagctcaccgcaacctctgcctcccgggttcaagcgattctcctgtctcagcctcccaaggagcagggattactggcatgtgccaccacgcccggctaatttttgtatttttagtagagacggggtttcaccatgttggcgaggctggtctcaaactcctgacctcatgatccacccacctcagcctcccaaagtgctgggattacaggcgtgagccaccatgcccggcctggaaaaaggtattttgaagcatagtgctggcgagcatgacatgcctacagaggccctgctcatcccaggcctgccagtttgtgccccgggttagagttctactaaaacaatctaaattctcacagtacatgttaataacctgagaaccaaagataaaaatccgtctgtctcaagacgtgtaaaatttcatagaaggccaacagaatcagagatacaataatgttcacaataaattctttagacaatttaatccaaagaaccaaataaaaacactgtcattgcaattttaaaaggctcgtaggcacatagtatgcatatcagaatttctgttgaacattgaatgctgggttttgttgggaggtggcagctatcattaaaatagaaaagtactaggagctgacttgatctgggcagtaacacaaaattaaacaaatgtatctacgtttaaaaaaagattcaaattcaaacttggaaggatacattatctgaaaataaaaaatgtttctagctggcagggaggtagaagagagccctgaaaataattgtctaacacctggattctagaccagctcttcctaaagcagcccatatattagtcatggtttctcttctgaaaaataggggttgggaccaaaaggccttccatgtcccttctagatctaagcatctctcactctaaaacagaaattgcaggctgggtgcagtggctcacgtctgtaatcctagcattttaggaggccaaagcaagcaaatcacctgacctcaggagttcaataccaagacaatgtgataaatacaaaaaattagccaggcatggtggtgcatgcctgtaataccagctacttgggaggctgaggcacgagaatcgcttgaacccaggaggccgaagttgtagtgagctgacattgcacctctgcaccccaccttgggagacagagtaagactctctcaaaacaaacaaacaaacatataaaaatttaaaaatatatatatatacaaaattagccaggcatggtggcccatgcctgtaatcccagctactcgggaggcagaagcaagagaatcaatggaacctgggaggtggaggttgcgctgagccaagattgcaccattgcactccagcctgagcaacaagagtgaaactccatctcaaaaagtaattaattaattaattaattaattaaattaaaaagtgaagcagaaattgcaaaccggtggcccactggccagataaaatccgtccaagttttgtttgccctgcatggagtttttgtttttttctaactgaatataaatgcctctaaattgaggccctccggtttgccacaattactgctgttccttattgccttgccccagcctgcttcccactttgccatcacctgcttggcccctgaaggactcgggcttgggactgccgtgctatggggctaagagatttccagcactgcacttgttcccattaccacttaaaccctactgaaagatgatctcaatttactttggtttctacctgcgttgctgagcaaatttcacagctttacaatttggacaggggtgggcaccctgtagagtactatcattcctattatacaggacactaatagctcaaaatacaaaagagacttgttcaaagtcacagagttagtaagtcagagagttaaaataatttctgtttgccaaggaaagtttcaatttgaaaaatctggaaatatacaaaccaaaagcaaatttcatatatacatgattataattaatatttatggcatacatcatgtttaattgcagaaatgtaatcatttatatattcaccattttgtatatatttgcttttttttttttaagagatgtgggtctcactctgttgcccaggttggaaataagtggctattcacaggcgtgatcataacacggcacagccttgaactgctgtgcgtgcaagtggtcctcttgcctcagcctcccgagtatctgggactataggtgtgcaacgccatgcccagcttttatgttgcatatatttggatgtagtcacttaggctattattgtagggtagtggctttttgttattgtggtaaaataatggttaaagtttaccattttaacccttttcaagtgtacagttcagcggcattaagtctatttacattattttcaactctcaccaacattcatctccagaactttttcatcttgtaaaactgagactccgaaacattgaaccatgactccctctagcccctgccccagcctttctgtctctatgaatttgcctgctctgggtacctcatactaatagaattctatagtaattctccttttgaaactggcttatttcccttagcttaacggatgaaccccgaagacattatgctaaaggaaatagaccagtcatggctttaaattctgactgtgattttatcgcagcaaaggtgtgtgttaaaaatggctatgaactttgtagatgcctagcaagagagcatggaatgtgaatgacccagcccggaagacttccttctgcatgaaatacccaaacatacaagtagcctttatgagcgaaactaaaaaaaggatttctgagcacaggctcctggcacataaagctcagaatagctgagcttcacttaccaactataacagcacaaaatgtcacgccgggaatattgaatgtgggagttcagtgctcaaggaaaaaaatcgctcacctaatttaaggaaaccctaaatgaatcaatttttttttgttgttaaaaactctgtattgcaacagtcccatctggtgctaactatatttgcttagagaaagcagtaccacaaaagaaaggttatttagagcatgcaatggtttctggatggttcttccatctactagagaacatgacagagacctaagaaattgaccctaaatatggacataaatttgtgtaaacgtaaggttagaaacatcacattctgggccgggtgtggtggctcacagctgtaatcccagcactttgggaagccaaggtgggtggatcacttgaagccaggagttggagaccagcctggccaacatggtgaaactctctacaaaaaatacaaaatacaaaatacaaaaattagccaggcgtggtgacgcatgcctgtagtcccagctacttgggaggcttcgatcacttggacccaggagacagaggctgcaatgagtctagatcaagccattacacaagaccctgtcaaaaaacaaacaaacaaacaaaaaaacaaacgggcacagtggctcatgcctgtaatcccagcactttgggaggccgacgcgggcggatcacaaggtcaggagttcgacactcctgaccaggagcccagccaatatggtgaagcccctgtctctactaaaaatacaaaaattagctgggcatggtggtgtgcacctatagtcccagctactcaggaggttgaagcaggagaatcactggaacctgggaggcggaggttgcagtgagctgagattgtgccactgcactccagcctgggcgacagagcgagactccacctaaaaaaaataaaaataaaaaaagaaatatcaccttctgggtcaagaagataatcagattcgttttaccttataccagaagcccttgcttctgtactgtccgtctccttgtaagatggtcaccctgggaaattggcaggatagcctgtcctaccttgtgagggtatttaaatgacggcagacttgatttcaggagagtgaccaaaatataggttagtttcctgctgtccacatcacaagagaggagtctgatgggaaacagaacgcagcctgctgggctttaccaggaaacacacgctgttcatctctcaggacccagcctcctgcccgtatccacacaccagctctgctcaagtgatcctcctgcctcagcctccagagtagctgggattataggtgggcaacaccgtgcctggtttttattttgcatatatttggatatagtaacttaggttttaactgtagcctcggtcaagctgtataacccctctgtgcctcagtttcctcatctgtgcagaagtggagcagcaacagaatctctgtcagaggactgctattgtggggatccagtgatgagtgtatctgaagcaacaaggccaccaaaccacagctgccgccgggcactggctgacgctttaggagtctcccagagtggatgatgagcaagggccatgctctacatttcgtgtgatttgaagtttttttaaatcatgtccccaaagcgatatgttctctcactagaccctccagaagaaaaaacaaaacaaaacagaatctaatatgtttaacacctaaccccaggtacctgtgaacgagaccttatttgaaaatagggttattgcagatttaattgagttacaatgtggtcatgctggaatagggcaggtcttcaattaaatatgtctggtgtccttataagaagagacacagaggccgggtgcggtggcgaggtggctcacacctgtaatcccaacactttgggaggccaaggcgggtggatcatctgaggtcaggagttcaagaccagcctggccaaaatggtgaaaccccatctctactaaaaatacaaaaattagccaggcgtggtggcgggcgcctgcaatcccagctactgaggaggctgaggcaggagaatcacttgaacctgggaggcagaggttgcggtgagccgagatcgcatcactgcactccagcctgggcaacaagcacgacactccatctcaaaaaaaaaaaaaaaaaaaaaaaagagagagagacacagagaggaaaacgccaagtgaagatactttacgcaagggcaatgaaaccaagtgatgacagaggcggatttggagctctatggctgcaagctgagaaacgccaaagactgccggcagccaccagatgctggagagtgcatgcagtggccaacccaaggattttgtaccctctggactatggaactgtgaaaaaatgaatttctttttttttttttttgagacggaatttcactctgtcgcccaggctggagtgccgtggcgtgatatcagctcactgcactccaaggttcaagcgattctcatgcctcagcctcccgagtagctggcattacaggcatccaccaccacgcctggttaatttttctgtttttagtagagatggggtttcaccatgttggccaggctggtctcaaactcctaaagtgatctgcctgcctcgggctcccaaagtgctgagattacagacatgagccaccgtgcccagccaaaaactaaaactgaatttctgttgttttaagccacacagtttctgttgctttgttaacaatagccctgggaaacaatgtcttagctgtttaaatcctctagggctggcagatagagggcatgtggtacatatccattgaatgaatgaataaatgagtaaagataaacacagaggtaaggcaagcaatggggaataaatgatggggcagatgtgggtgcacacacacacctggagggggagagcccacacacacacctggagggggacagagcacatgcacacctggagggggacagagcccacacacatacctggagggggacagagcacatgcacacctggagggggagagcccaaacacacacctggagggggacagagcacagacacacctggaggggaatagtgcatacccacacctggaggggggacacagcacatgcacacctggagggggacagtgcccacacacacctggagggggacagagcctacatacacacctggagggggacagagcacacgcacacctggaggggaacactgcacacccatacctggagggagacagagcccacgcacacctggagggggagagtacatgcacacctggagggggacagagcccatgcacacctggagggggagagtacatgcacacctggagggggacagagcccaagcacacctggaggggatacagcccacgcacacctggagggggacagagcacacgtacacctggagggggagagcacaagcacacctggagggggagagcacacgcgcacctggaggggaacacagcacacgcacacctggagggggacagagcacacgtacacctggaggggagagcacacgcacacctggagggggagagcacacacacacctggagggggacagtgcacacgtacacctggagggggagaacacacgcacacctggaaggggagagcacacacacacacatggatagggagtcactcgttcttttctatgagcattcagtccccaactttgggtctaaaaggtcagctgaaacttggctcctggaaaatctatcatgtcggtatgtcccagagtacaagggcttccgactgtccaaggaaccagaaatctgaatttttaggtgaaatcttccatgtttttcttttctttttttgagacggagtctcacactggcgcccaggctatagtgcaatggcacgatcttggctcactgcaagctcagcctcccggattcaagcgattctcctgcctcagcctcccgagtagctgggattacaggcacccgccaccacgcccggctaattttttgtatttttagtagagatggcgtttcaccgtgttagccaggaaggtctcaatctcctgacctccacccaccttagcctcccaaagtgctgcaattacaggtgtgagccacaatgcccggcctaaaatctttcatatttttcaatgctgtcttacaaaagaagtccccactctggggtccatttgcatctccagtgtctggcgccccccgggcaggatatgcagtggctaatgaaaatctgtagcataaaggaaaacgcatcctcacaggtctgaagacagcacacctgagtggatcttctgggatagtgttagctatcagggttatgacttggatcctgcctcccctcatgtgaaactttcaaaagcactggagtaaaggaaatccagctgagggaagagaggcaaatccctgggacccagatgcaccacacaggactattagtccctagtcagggggaagagctctgaagctgggaatcaggacacctgaccccccaactggaggcaaatcatctctctgagtctcggcttcctcgtccataaaatgaaggaataaaatgtatacttgccacctcccaaggtgtgaggaggacagtgagagagcatgggtgacgaggctttgtcagcacggcaaggccattggcaccttcctaattctaacagccatgatcagtctaatgccactcccatcacgtcgccattagacccggggaccacttctccaacacacccattggggcagagattttgttcttcttatccacagactatctaaattagggcagctcgaatatctcaaaagaaagctgctgagactatgctgacgggaagaagggtatttgggttccaacatcatgggcgtcccccagttttaaggcacaggacagtcctgggatcagcagctcctgcaacccctgagaatttgtcactggggtgctgtgtgtgtcttcaatgtgaccaagacaacaccaatccaatattgtagggcctgctctgatccatccacatttctctgtcatctgctacacgtaggacgctgcgcaggcagaatcaatgccattttgtgtttttttctttttccaggaatgggacaatgcaggatggctgctgggtgggatcacagctccacacttcggaggaggaagactttgtgtcagtctccagtgatccctcacctggacccctatctttcctcaaacacctctgcttcctgcctctgtcccttttggaactaaaggcctgttcctcagccaaagtccagaatcctttcttctcaagcatgagtcccctgccctccagttgcttggcccagtaaggaagtcagagaaggaaacaggcaactgcaatcaagtgacatgaatgccagtggtgtggcgtaggtgcagcctagccatgggatgggcaggtcacgaaggcagggagacatgctgttcagagcatcagagatttcacgaagggcaagcttcagtggggtgtccagcaagcagatatttgcctctacttgtttacatgtgacctcctgggcagggtctgtgatgtaggcgggcctgcaccctcactgcctagcacagaattatgtattgatagggatgcactagattaccatggtttaggacaccagccctcacgtcagccgatgcctctgtactcaccagataaccttcagttcccttccagcagcttcaaatgtctgctctatgaacacccctgtgactggctggtgctagaagaaaaattatgcatataccctgtagcttgtcctgaagtaggggggacaagaacttcagttaacagtgtgcagctttaaaagttgagaggttgggcacggtggctcacacctgtaatcccagcactttgggaggccgagatgggcggatcacctgaggctgggagttcgagaccagcatgaccaacatggagaaaccccgtctcttactaaaaatacaaaactagccgggcatggtagcaggtgcctgtaatcccagctactgaggaggctgaggcaggcgaatcacttgaacccaggaggcagaggttgcaagagctgagatcgtgccattgcattccagcctggcaacggagcgagactccatctcaaaaaaaaaagaaaaaaaaaaagttgagaggtgggtgtcacagaggaggaccactgcccctcacagtgtacaatatctgagtccatttgagagctcacagctcagaaacacaaggctctcagtccatgcagagttgatcttggtggggggtgggagggaggggacactcattcacattcaacagagtcacagccaatgtgtaaacaaccagaaggccagtttaccaatctacctttccagcagctattcctgtcatcagggcatgcactgaggtgtgcaattcatgcactcattcagcaaggttttgacaagcaccaagtgtccattagtgcacggactgtgagcacctgactggggaaaataatgcagccaaatgaggtggagatccagaaacgggaagtggaattgtgcaatgagcttggcgtcacacaagctggagttcaaacgctgtccatcatttattagggaggcgactttggggaaaattgcttaaccttcctgagtctctttcctcacctgtaaaatgggtataacaacatctccttacatgattattaaagaatgggattacatatgtaaaatgcctagttttgtttgtttttgtatttatctggagaggccatgccacataatttttaagggaacaggctttgggatcagacagagctgtctttaaatcctagctctgccacttactaggtacatgatttgggtaagttgcttaatttttttccactaagccttggttcgctcatttgtaaaatggaaatacgaattcctcatagggcctgggaaataagataatgtattccaagaacttagaaaactcctaggatatgataagcatttaacaaatggtatgattaagagtaatttttaggtgccaatatccagaataaacaaggaactcaaacaactcagtgacaaaaaataaataaatctgatttttaaatagacaaacgatctcaatagatatttctccaagaaagacatacaagtggccaacacatgtatgaaaaaatgctcaatgtcactaatcaacagggaaacgcaaatcaaaaccacaaagacaaaaaatagcaaatgctggcaagggtgcagagaaaagggaactctgatgcactgtgggtgggaaggtaaattagtacagccattagggaaaacagcatggaggtttctcaaaaaactaaaaatagatcttccatatgatccagcaatcccactactaggtatttatccaaaggaaatcaaatcaatattatcaaagagatatctgcacccccatgtttattgcagcgccagtcacaatagcaaaagatatggaatcaacttaagcgtccaccaacaaatgaatggacaggctggttgcagtggctcatgcctgtaatcccagcacttcaggatgccgaggtgggaggactgcttgaggccaggagttcgagaccagcctaggcaacatagtgagccccccccccacccctcccgcgccatcttattatttaaaaaaaaaaaaaaaggataaagaaaatgtgttataggctgggcgtggtggctcacgcctgtactcccaggactttgggaggccaaggcaggtggatcacacaggagttcaagacagaccagcctgtccaatacagtgaaaccctgtctctactaaaaaaaaaaaaaaaaaattagccgggcttgatggcacgcacctgttgtcccagccacttgggaggctgaggcaggagaatcgcctgaacctgggagccggaggttgcagtgaactgagatcagaccacttgcactccagcctgggtgatacagtgagactccgtctcaaaaaaaaaaagttttacatatactggaacactattcagtcataaaaaaataatgaaatccttttatctgaagcaacatggctgagactggaggacagtatcatattaagtgaaataagtcaggcacagaaagataaataccacatattctcattcatatgtgggagctaaaaaaaaattcgagttcatggaagtagagacttgaattgtggtttattagaagctgggaaggctagtgggaggagaggagagggagaggttgatacaaaattgcagctcaataagttctagtgctctgtagtatttcaaggtaaatatacttaacaacaatctattgtatattttcaaaaagctagaagagagaattctgaatgttcccaacacaaagaaatgataaacatctgaggtgatggatatgctgattactgtgctttgatcattacacgttgtatacatgtactgaaatatcactttgtatcccacaaatgtgttattatgtattaactaaaaataaaagggagaaaaagaacacaaaagtatttttttaagttgtccatggttgcatacaaatgagtggtacacatattaaaaagcagttaaaattattacaaacttcaacgaaattaaaaattgtgccactaaacatacaaaaaagctaattacttcgtgtttcattaaaacttttctgaaaaggcaggcctctcacctcagactagtttcatgcctatactttccaacagagtttctaaaataacatcatttttgtgctgccaagcaaaaagtcagatctgtttcaatactgctaagtcatgctccacagtgaaacagcagcagcatgtctgggatccccttttctagtttgtctgatgggaaccctggtactcacaaggcactgtgcacttggcttaacaactatacaccaaggtacacactgcgggattataaaagtccctgccctaaaggacacaaatcacctctcaattctggattgtgcctttatttcttcctaccaacactgccaatttttaagttgtttataaagcttttagttatggaagcacgatcttggattttgatataaaaatcaacatagctgccaattctaacctcagtgcaaatgcaactggtccaaaacaaagggcagccccttatctacctcatcctgtcctcagcaacatttctcttttccagatcgggaaacctgcacggccgctcaggacttctcgatgactgcaccttagagaccagagtgcaggttagcggggctctcgctccatcagtcaagtgaggtcttcaaacttcagggtgaactatggatgtgtttttaagactcaagttttcacaaaaaaaatccaagtttcagaaagaatgggagagtttcaacagaactaaaatatgagagcctctctctaaataataaaaattttctttttttttttttttggagacagtctcgctctgttgtccaggctggagtgcagtggtgtgatctcggctcactgtaacctgtgcctcccgggttcaaggattctcctgcctcagcctcccgagtagctgggattacaagcgagccaccacgcccagctaattttttgtatttttagtagagacagggttccaccatattggccaggctggtctcaaattcccgacctcaggtgatccgcccacctcagcctcccaaagtgctgggattacagacgtgagccaccgcgaccggcctaaataatagtaattttcaacggaatacattggaatctcattataaatgcctgctctgggctacgatttgcttatcaaagaattcacaagtcataaactagagggggtggactcgacgtgatgcccactaggagaaaggtgacaagagaagcacgaaggatagcgcttttcaaccctgggagagcagggaggccttcaccagaaggtgggaacccaccacgaagcgccttcaggaggccccaggattccaaaccaattaagggcctcctcttccgaaaacgggaggcgacgcgctgagctaagcgcgcaggctgggttgcgggccgacaccgaggcggcgcggcctcgcgaccgccctgggcggtcactggcgagtcacggactcgttccgccagcggccaatccaccccgagtccgaaacagaagacgtccctgggatgaaagacccaggcctggggcttaaggtggaaaaacaactcattcctcgaggcccggagtcgggcgtcccgggagaacgggaaagggagatgagcgcccgctgcggggagaacgcggtcgggttcctctccccgaaggtggcagccgcaaaaacacggcctcgaaagcagtttcgaggacgatggctcctgcgtcccgggagtcgccatgacgccgcggcctgtcccagacccggcgagggaggggaccaaccaccatctccccctcaaggcccaaaccgacaaagaacggcccccggtaccccggccccgccaccagggccactccgggtctcgcgagacccaagggctgcgccgcgaagacctctgggaaaggcggggggaggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacggtgagtcgcgggcgcggcgggccaggagatggcggccgcacaagatggcggcggccgccgcgtgaccccgccgcggcgtgtggcgcagtttgggcggacggcgggcgggcgcgggcccgggcgccggccgccccctccccgcgcgctccccggcccggcctcgccccctccccggcatggcgggagcgcgtcgcgcgtgcccgccgctcgggctgactcaggcttcagctgctgcatttgtgagtcatcgcgcgctctggggcgggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggtaataaactgctcttcaatttagttgatagctctttttgtagaattttgaagtttgcatttgtcaggggaaactgcacaactaaaattcttatttcctttaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttgagctgcaaaacttgttctaattgtatgctagctaattaccttacaagttaagtgaggaaccgtggtttattggttgccatgagtttacaaaactaccaggggaacgcatttaaagagtggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctggtgagtcttccatgatgaactcctaagatcctaagataagttactaactgttgggaacaaaatagaaggtttttttgtaataggaatgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtaaacattgggggaggagggtattggatacagtgctggcatgggtgtttgagatttaaaaaggtttgtgaggagtgatataatggcagtttggggtaatttcaggtttagaatttaagatgcagtaaaatacagcctctcaataatttggaaaataatagaaagggtgatggaaactgtgttcctactcctacacattatagtctataaaaaaactttaaaaatgctcttagactggagcctgtgtaagagaacttgcagtgtttgcataacagagctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaagcggagtcacttgtgttcaagaaacaaaaaaacaacccgaacaaatagagtagggtttgcagtcttgcgatggtgaagggtctcatgctggtatgcccaataacgaaattatcacaaaagattgcaaaaaccacagccttgcacaaaaagcatcacagccttatgcaaaaaatacttcaaggacatctacccagcaacagcctgtccagctgtggacttgcatcgcccttgttatggatctttgtagccacaggtggtaatctcaaaacagttatgtaatcttcatttatcctttaaaaaccattctcggccacgcgtggtggctcacgcctgtaataacagcactttgggaggccgaggagggtggatcacctgaggttgggagtttgagaccagcctgaccaatgtggcgaaacctcatctctactaaaaatacaaaaacttagccaggtggggtggtgcatgcctgtaatcccagctactcggctgaggcaggagaatcgcttgaacctgggaggtggatgttgcagtgagccgagatcgtgctactgtgctccagcctgggcgacagagtgagactccatctcaaaaaaaaaaaaaaaattctctccctttacctccctaaagtacacacacagctcacaatgacgtgtattcccattgcaatgccctattcctgaatacatatctttcttttagagagctcgtctctctcatttaattgacataaatggggtcagaaatgggacctaaagaaagatgactatcagaaaaaaatactcttttttggccagtatgcatgagccctttgcgctgtaggcttccatggctcaaatttttgtccctggtgagtcttctctcaggccagccctccctgtttttggtggaggctttgtttttcttttcttttttctttttttccttttttttttttttgagacggagtcttgctctgtagcccaggctggagtgcagtggcgcaatcccggctcactgcaagctccgtctcctggattcaccccgttctcctgcctcagcctccagagtagctgggacgacaggcgcacgctgccacatccggctaattttttgtatttttagtagacacggggtttcaccatgttagccaggatggtctcgatctcctgacctcgtgatctgcccgccttggcctcccaaagtggtgggattacaggcgtgagccactgtgcctggcctatttttttttcttttcttttttttttttttttggtagaggctttttgatattcaagatcaggtttggttataaggccaccttaataaagaaccttacatccctcctgagatgataaaagactgacttttctggtaagtcctttctggtataaagacagaggtctctagcttgagtattctggtttctattgaattcacattctatctgtgaggcatgtcatttctggtgaattcacttttggtctgagcgtgtaatttgatctgcatgcctgggttaaaattttgtgaacactcatctcttggtgtcctgtgatttggtttcactcgtttccctgggtttttttctaaacaccttccacgttttaaatagtgggctcaggatgtctaattaaaagccactagggcagttgccaccatctaaaacaccaatccaaactcctgacattctctcacaggataaaaaagatattctggtcgggcacagtggctcacgcctgtaatcccaacactttgggaggctgaggtaggaggatcacttgagaccaggagtttgagaccagcctgggcaacaaagtgataccctgtctctacaaaaaaaactgaaaaatttagccaggcacagtggcctgcacctgtagtcccagctactcaagaggctaaggtaggaggatcccttgagcccaagagttcaaggttgcagagagctatgatcgtaccaccgcagtccagcctgggtgtcagagcaagaccctgtctcaaaaaaagaaattttacagaagtacaactcctaacagaataatgctggcctggcgctttgaaatgattgcaaaaaaactatggaacagacaaaattgaactcaataatggactctaagtagacttagctgacagccactcccttcgaacctccctcgttgttcacaggtggctagaaggttttgacactggctcctagtccccaatcactccctgcagtgtgggacaagactggcagccaggacagatccaccctggtatcaagggacaatcaagacccagccacaggatgactgaccagcgatgctttcagagagagatgctgaccagaggcggaaacgtgaaggctgtcagaatgagaatggagtcatttgtattttaaaaggcaaacaccaaacaaaaaaaaaccctgagaaatagagccaggtgaggctgtgaagagagcattctcatgcttgtttgtcctatcacgactgtcaacgatcacaaaagactgcaaaaaccacaacctgcacaaaggccgtcacaaccttccacaaataatacttctacaaggacatctacccagcaactgcctgtccaaccttggaccggcgtcggccttgttattgaccttcatggccaaggctgattatctcaaaacaattatgtaatcctcctcacttttcctttaaaagctattctctccctttaccttcctaaagtacacacatagctcactatgacatgcatattcccattgcaatgccctgttcgcagatacctttttctttgagagagcctctctctgtttattttgttgacaaaccaagaaaagtcattaggaataaagaggatcagcacaatgtgatgaacaattcaacacatcagaaataaaagttctgactgggcacggtggctcacgcctgtaatctaagcactttgggaggccaaggcgggtgggtcacctgaggtcaggagttcgagaccagcctggccactactaaaaaatacaaaaattagccaggcgtggaggtgagtgcctgtaatcccagctactcagtaggctgaggcaggagaattgcttgaaccccaggaagcagaggttgcagtaagctgagatcgcaccactgcactccggccagggcgacagagcaagactctgtctcaaaaaaaaaaaaaaagaaataacagttctatcactgaatgcaccgatgaaatactctcaaaatatataaagcaaaagtttacaaaagagccgtagtgaaataccactacacacccaccagaacagctgaaatttgaaacttgacaacaccaaatagatggtgaggaagtggggccactggaactcttacatactgtgggttggtatgtaatatgataccaacactttaggaaaagttctaacaatttcttacaaaaactgaacatacacctgccttctaaacccacaattccactcctagagaactccacacttaatagaaatgaggccaggcgctgtggctcacgcctctaatctcagcactttgggaggctgagggaggtggatcacgaggtcaatagatccagaccatcctggccaacatggtgaaaccctgtcgctactaaaaatacaaaaattagctgggcatgtggcacacgcctgtagtcccagctactcgagaggctgcggcaggtgaatcacttgaacccaggaggcggagcttgcagtgagctgaggtcgtgccactgcactccagcctggtgaaagatcgagactttgatgcaagaaatacataaataaataaatatgaaagcaagcgttcctgaaaacacttatgagaatggctattgcagctttttttcataataatcccaaactgtaaacatcacaaggacctattaacaggagaatggataaacaaactgtaccatatgctcaaaattggatattaacaataaaaaggaatgaattactaatgtgcacaacaaaagttatgaatctcaaaaatgtactaaatgaaagaagccttaacaaagaagaatacgtatgtacagttccatttatatgaagttctaaaacaggctacactgatctgtggtgaagaaatcaagacagtgattgcttctgtggatggtgtggggtggggattgatgggaaagggcacaggggaaccttccacggtgacagcaatgttttatatcttgatagaagtttgggttacataggtgtatgggtatatgcatttgtcccaaatttgttcatttcattgcatgtaaattttaccttaggccgggcacggtggcttatgtctgtaatcccgcactttgggaggcccaggtggctggatcacctgaggtcaggagttcgagaccagcctggccaacatggtgaaatcctgtctgtactaaaaatacaaacattagctaggtgtggtggcaggcatctgtaatcccagctactcgggaggctgaggcaggagaatcgcttgaacccaggagacagaggttacagtgagccgagatcggccattgcactccagtctgggcgacaagagcaaaactctgtctcaaaaaataaaacaaagtacaaaaaactagcagtatgtggtggcacatgtctgtagtcatagctactcaggaggctgagatggggaactcgcttaagcctgggaagttgaggctacagtgaaccatgatcatgccactgcacttgagcctgggggacagagtaagaccctgtctcaaaaaaaaaatagataaaatagatatacaagatatatattgtatatacagatatttcaattaaaatatataaaatatgaaattatgtatttcattacatgtctaagattctcagagtggccatggcaaccagtgtctctcaagatggcagctgtggtgtcagcatgggtcccagaatgggtggagcagagcgcccagtggaccctcaagggagctggaacatcagtgagaaatcacctttgttgtaggaagtcactgagacagggacagtgtggtcagcagagcctccttgactgaggtgtgcccgacgctgagcgtgtccttttctaagttctcctttcagtctacgtcagtctgcatcagtctatgtcagtccatgtcagtctatgtcagtctacgtcagtccacgtcagtctatgtcagtccacgtcaatctacatcagtctatgtcagtctatgtcagtgcatttcagtctacatcagtccatgtcagtctacaacagtctacgtcagtccacgtcagtctacgtcagtctacatcagtccatgtcagtctacgtcagtccatgtcagtctacgtcagtctacgccagtctgtcagtctatgtcagtctatgttagtctatgtcagtccatgtcagtctatgccagtctatgttagtctatgtcagtctatgtcagtaagtaaaagggatttttgctgaaacatttctttgtcatgcctgtggctagccgcccagataccctctacagaaaagagtcaatgttatcagaaatagtttatgcatattcaagcaaaatcatactttttctccttttttataacacaaacgattgcatgttttacatcctgttctgaaccctgtttctttcgctttatattttggaaattattccatagtagtacatgtatattttcctaatcagtttttatagcaaaataatattccattgctagaaggtagcaatatttatttatttaaccagtgccctattgatggacctttgagaagtttccagtcttttgctattacaaacaatactgggttaacctttagtatactggaaaaaagaattatataataatttacctcgggtccaaaggacccttttaattttatttatattttaagtagcctcataataatttacagaagaataaagggatcataacaaacaaccttattagaaattataataagaatgtaagtgtaggaaacccaaatttcaatcccaaattttcctgttttgaaagtatatataccaagaaagggctgggcacggtggctcacacctgtatcccagcactttggaggccgaggtgggtggatcccttgaggtcaggagttcgaggccagcctgggcaacatggcaaaaccccatctctacaaataaaacaaaacaaaacaaaacaaaaaaaatagctgggcatgatggtgcattcctgtagtcccagatacttggggggctgagatgagaggatcacttgagctgaagaggcacaggttctcagctgagatcgagccactgcactccagcctgggtgacagaatgaaacgctgtcttaaaaaaaagaaagaggtggctgggtgcagtggctcacgcctgtaatcccaggactttgggaggctgaggcgggcggatcatctgaggtcaggagttagagaccagcctggccaacgtggtgaaaccctgcctctactaaaaatacaaaaattagccgggtgtggtggcgggcgcctataatcccagctacttgggaggctgaggcaggagaatcgcttgaacccgggaggcagtttgtggtgagccgagattgtgccattgcattccaccctgggtgacaagagtgaaattctgtcaaaaagaaagaaaggaaagaaagaaggaaagaaggaaggaaggagggaaggaagtaaggaaggaagggagggagggagggaagaaaagagaagaggaaagaaaaaaaagaaaagagaaaagaaagagaaagaaaaagaaagaaaaaaagaaagaaagaaaaagaaaaaaaagaaagaggccaggagtggtggctcacacctataatcccagcactttgggaggccaaggcaggtggatcatctgaggtcaggagtttgagaccagcctggccaacacagtgaaaccccatctctactaaaaataaaaattagccgggtgtggtggtgggcacctgtaatcccagctacttgggaggctgaggcaggagaattgcttgaacccgggaggcggaggttgcagtgagtcaagatcgcgccactgcactgtagcctaggcaacaagagcaaaactctgtctcaaaaaagaaagtatatataccaagaatggactgaatacaatgactcacatctgtaatcccagcactttgggaggacaaggtggaaggattgcttgatcccaggagttcaagaccagcccaggcaacatagcaagaccctgtctctgttaaaaaaaaaaaaaaaaaaaaaaaagactaggcaatgtcctttgctttccacttactgctcatgccctgtcttgtatgttgaatctagaacatatccatcttgtaaaaactgcttccagatttcaactacatctttagtaggttttagcttatcatgacttctcactcttctctttgaatctgtgaaacccaatacttttgaaaactttgacactcataattttgttgagaggatggccatcttctttgttccataattgtgaaatattgtcatggttagatttataaaccccaattaaatggtcaatccaatgaattgttttcatttcttcatcatctatttccttccaatcacccccgtgtatccaactttatcatccacttactgaatgtatcaagtaaagtatgtacacaaacatcgtaaaagatgaagaaatattatcatgcatccttttaacaaaatgtatcccatttcttgtcacaaaacgttgtgttgctagttcttcctgttgaaggactgaatatggatatgagaatccataattcagccgggtgcggtggctcatgcctgtaatcccgacactttgggagaccgaggtgggtggatcacttgagcccaggagttcgagaccagactgggcaacatgacaaaactccgtctctacaaaaattacaaaaagtagctgggcatggtggctcgagcctgtagtcccagctattaggaaggctggggtgggactgcttgagcctgggaagtcaaggctgcagtgagccaagatcactccactgcactccagcctgggcaacaggagcaagatccagatttcctttttgtcctcagatgcatattgttcactctttgatgcttgcatttaagagaactcatctagggtatggtcatctgaagagtcatggagggttttttgttttgttttgttttgttttttaggtggagttttgctctgtcgcccaggctggagtccaatggcacgatctcggctcactgcagcctccacctcccaagttcaagtgattctcctgcttcagcctcccgagtagctgggattacaggcacgtgccaccatgtctggctaatttttgtatttttaggagagatggggtttcaccatgttggctaagctggtctcaaactcctaacgtcaggtgatctgcctgcctcagcctcccaaagtgctgggattacaggcatgagccactgtgcccggccagagatttcttttctatgatccattttaccatcacaattggcatcttgacacagtgctgttctctgtctctgcacacatctcctgattgtctaagaagcatgagccccgtgagtgttgactgccagagttcacgcccaccttctctccagccaattgccttggaagaataggtactgccttgtctgataagtcagcagcgaatgacagactcacaatgtgaaatgcccatcccttgctttgatgtgggatgaacccagatgcaatttttgctccaagctttccatgggaccagactgaagccacacggaccccacccgagaccacagccgtgcttaccctttttcctttgccctctccgattttcctcactctcttctccttagaaagctgatatagtttgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtctcagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaagaaagctgatatagtttggatatttgtcccacccaaatacgtttaaatgtatctccagtgttggaggtggggcctggtgggaggtgactggatcatggaggtggatttcccatgaaatagtttagcatcatcctcttggtgctgttctcatgatagtgcatgagttctcacaagatctggatgtttaaaagtgtgcggcacctcccacccactctcctgctcccgctcctgcctggtgaaacacctgatcccgctttgccttccgcttttgcttcctgaggcctcaccagaagatgctggcactatgtttcctatacagcctgcagaactaggagacaaatcagcctcttttcttacaaattacccagcctcgggtatttctttatagcaatgtaagaaacggctgaatgcatgcacactgtaataaattacttttacaagaatccccattgcaggtgccgcttataggaacttgacctaggatagctggaaccagagccatcccatgaaggagaccgcaaggatggaattccttaagggtgactcactggctgaatggtagtgaggacccagcaggtggaatattgacagtccctgaagtgtccgagccctgcagtggctaaaactttcacctgtgctgccccgggggcacagcagcatccgtttatggtcttcccaacagcgatgtgaattgtgcagctctctgtcacaatagaattcaagacctgaaccctggctgctgcagatgtcctgaggctggatgtgatactcatcatctccctcctcccactatgaggccataggtgtagctgagggagaggtgttggtacaatactagcagatgactcgggtgtctgagccacctgctgtgcagcccattgcgccccctggtcctgccatgctgtactgcagatgtaccacttccatctcactgtgggttactgttgggtccacctgacctgaagacttggtgggtccagcagaatcagctcttttatttatttatttatttatttatttatttatttatttattttttggagatggagtcttgctctgccacccaggccagagtgcagtggcatgatctcagctcactgcaacctcctcctcctgggttcaagcgattctcctgtctcagcctcccaagtagctgggattacaggcaccttgccaccacgcctggctaattcttgcatgtttagtagagatggagtttcaccatcttggccaggctggtgatccttcagtgatccaccttcagtggtcactgaccactgaccttcagtgattcacctgcctcggcctcccaaagtgctgggattacaggcatgagccactgcgtccggccagaatgaactcatcttgggaagttctagccatcagacagtttctagcagggtccaggagcgcatcagggctgctttttgaatggtttgtagttctctgttgtgtaaggcacagactttctccagaacccagggggtctgtactgggaagtagcatctttcccaaccacagccccctctagttccattgcacctgctgagtcatgggtgcatgcaggaagctgctcttgtggcagcctgggctgctggagagctctttctgctcctggcccaacgcaaaaccagcagtcttccatgtgacctgatgaatgggttaaactgtccatgtggaggctcctgagtctccgtaggctttatctccagtcccctggatggcatgtgtcttaccacggcatctgctctgattaacgtgacgccctctatatggtggccaacatgctgttttgcagaatgtctagatggttcagggtggaggaagataatgagtatcaagtacagcctcagggcattggcagcagccagactgtggttcttcccactaactctcgtcttgtaaatgtccccagaaaagtgtgaccaaccagagtcacggagaagtcgtgcctggtcgggaccacctggcagtgagaagtaagtgggtctgaatggggcagaaaggtcagaggctggccccggatgctgttgaaagtgtcatatcaacactgtgctgattcccttcagggttcttttagaggagggaaataaacatttgccttgttttgcatattttttcttatgcatgcagccaaaactcgtcaaagctggtatataggggaagataaatacccccaagaacaacgtgagtgtcagagaaatctcccgcccaacatcagaagagatagcctagccagagcagcccaaacacaccatgagcaaaatgaaagtaaacagcttggtagatatgcaagcatacacagggccactacaaggaagcaaaaacgtcagtgtcatgaagcaccaaaaaataaataaataaataaaataaaatttaaaagtcttctttaatctagaaagaaggttgctatggactaaacagtatcctcccaaaatttctatattgcagaccaaactcccagtgtgatggtatttggagatagagcctttgggaggtcatagggttagatgaggtcaaagggtggggccttcatgaggggattagtactcttataataagagacaccggaaagcacttctgtttttcttttcttttccttttcttttctttttttttttttttttgagacacgatcttcctccattgcccaggctagagtacagtggcccaatctcagctcactgcagccttgacctcccgggctcaagtgattctctcacctcagcctcccaagtagctgggactacaggcatgtgtcaccatgcccagctaattttgttaatttatttattttttgtagagacaaggtctcattatgctccccaggctggtcttgactcctggattcaagcaatcctcctgcctcagcttcccaaagtgcagggattacaggtatgagccaccacacttagcacagaaagcattcttgagtgtgttctctcttctctctcttctcttctcttctctctctctctctctctcctgtctctctctcttctctctcttctcttctttctcttctctccctctctctctctctctctctctctctctctctctctctctgtcccctgtgggggtcacaggaagaagacagcaagccaggaagagagccctcactgggagctgatcatgctgacaccacgatcttggactttccagcctccagaaggacaagaaaataaatctctattgtgtaagccaatcagtctatggtattttgttatggcaactaaagcagactaaagatacatttctgctaaatgcaatgtgtgatcctcagttggagtctgattttttaattcaacctgcaaaggaaaaaacaaacaaggacaagtataaaaacagatatggtgaaattcaatccaaggcagaaaagcaggtgtccccagatccatctccccataaaagagctcataacagtggctcacgcctgtaatcccagcattttgggaggccgaggcaggtggatcagttgaggtcaggagttcgagaccagcctggccagcacagtgaaaccccatctctacaaaaatacaaaaattagccgggcatggtggcaggcacctgtaatcccagctactcgggaggctgagacaggagaattgcttgaacctgggaggtggaggttgcggtgagccaagatcgcgccactgtgctctagcctgggcaacggagcaagactccatctaaaagaaaaaaaaaaaaaagagctcataagactgtgacgtggtgaggcaacaactcagagacagggcaggagcagacagaaccaagataataacactgcacatctaatggataatgaaacagcaagaggccaggcacggtggctcacacctggcagctcccaccttccagcactttgggaggccaaggcgtgccatcttttgagctcaggagttcgaggccagcctgggcaatatagtgagacaccgtctctaaaaaatatacaaaaattagcaggacatgtctgtgcatgcctgtagtctcagcgactctggaggctgatgtgggagaatcacctgagcaaggatggggaggctgtggtgaaccaagatgggggcaggagaattgcttgaacctgggaggcagaggttgcagtgagccggggtcatgccactgcactccagcctgggcgacagagacagagtctgtctccaaaaaaaaaaaaaaaaaaaaaaaatacaagctttggaattggcctgtagtaactgaactttctgtttgaggtttttctggtgattaacctctaactactatataacacgggtacatagctataagttgctgtcactttgagacattatcccttggggtctcaggtgacacctgtagaggtgactcaccaccccatccccccacatcttcctctcaatgtggttattactattttctattattattttcatttttttttaaaccgagtctcactctgttgcctaggctggagtgcagtggtgtgatcccagctcactgcaacctccgcctcccaggttcaagcgattctcctgcatcagcctccctagtagctggaattacaggcatgtacaaccgctcccagctaattttcgttgttgttgttgtatttttagtagagatggggtttcaccatgttggccaggctagtctccaactcctgacctcaagtgatccgcctaccttagcctcccaatgtgttgggatttcaggtgtggctcacaccacgcctggccattattattattttcaatccctctattggttccttccataagcttaaacataatatttgcgattttattactggttcttctatccatagaggcttctcttgattcccaacaagggaagatgaagatatttgtttctctaaccttggctttataacctccaccttccaactcccaacttaagtcgtctgtactattacttttatactgtcagaattgatagtatttataatctgcttgcagtagaaataaactggttttttgttgttgttgttgttgttgggtttttcttgagacagggtctcactctgtcacccaggctggagtgcagtggtgccatcacagcccactgcagcctcgacctcctgggctcaagggatcctcccacctcagcctcccaagtggctgggaccacaggtcaatgccaccacacctggctaattttttaatttttttgtagagattggatctcactatgttgcccaggctggtcttgaactcctcaactcaagcaatccccctgcctcagtctcctaaagagttgggattacaggcgtgagccactgcacctggcccagaataaagctttctgtcctttacttataggtcgattctaaaggcgaagattggggcaacacttttcttttttctttttttttttttttttaagatggagtctcgctctgtcgcccaggctggagtgcaggtggcacgatctcagctcactgcaagctccgcctcccaggttcacgccattctcttgcctcagcctcctgagtagctgggactacaggcgcccgccaccacgcctggctaattttttgtatttttagtagagacggggtttcaccgtgttagccaggcgatctcctgacctcgtgatccacctgcctcggcctcccaaagtgctgggattacgggcgtgagccaccgcgcccggccaacacttttctttataagataatacaaaatgtcatcactgtagaaccaagttgtgcagtgccacatttttctttattcaacttttgcttttttccctagagttggaagttgccttttttgttttgttttgttttgttttgagacggagtctcgctctgtcactcaggctggagtgcagtggcgcgatctctactcactgcaactttcacctttgggctcaagcaattctcctgcctgcctcaacctcccgagtagctgggattacaggcactcgccaccacgccttgctaattttttgtatttgtagtagagatggagtttaaccatgttggccaggctggtctggaactcctgaccttgagcgatctgcccgccttggcttcccaaagtgtagagattacaggcgtgagccaccaagcccgatggcaagttgcttttctttctgtgttgcgttgtcttcctttactgcatctcaagcctcttccagaatctcaagggtgctctggcatctgtggaatcaccttgttttcaggacgcctctctcccgctgctgtcgtgccctgctccagtccgagcctgcacccactgtctcccaggtcttccttcattgctgtctgagttgaatcttctgtttcctggatcccatgtgttcccctctctgccatcgcaaatcaccaaggaacctctccagaaagggtatgtgggagagaaattattctgagtccatgtgtcttaggttttgctgtataacaaactaccacaaagcacagtggcgaaacaaccatttatttcttccttacatatctgcagctcaactgtggttcagcgggtccaggccaggcctggctgggcttgactctggactgcggatcagctcccagtctgctccaaccatcttttgtcccacgtgaaccagcagctaccagactgatatctctcttggtgaaagacacaagcccaggcccatggcaagcatatttcaagtttctgctgggtcacacacatctgcttccatctgattagccaaagcaagtcacacggctcagtccaacagcaacggagcaaggaagtcggcacctcccacagagctcaggggaaaggagtgaatatttgctaggtaataatagaatcttccacagcatgtagttctaaaaatgtctttattctaggcctggcacggtggctcacacctgtaatcccagcactctgggaggccgaggtgggcagatcatctgaggtcaagagttcaagaccagcctggccaacatggtgaaaccccgtctctactaaaaatacaaaaattagccgggcatggtggcaggcacctgtaatcccagctactcgggaggctgaggcaggagaatcacttgaacccaggaggcagaggttgcagtgagctgagatcacaccattgcacgccagcctgggcaacagagcgagactccatctcaaaaaaaaaaacaagtttttattctgccctaacattttgttggtaaattagctaggtatagaatttcaagtttcagattatttttattgagaacattgaaggcattgctccagggtcctcaagcatccaatgaggctgataaatttgatgtgattggattttcattccttagtaggttaatttctctctctctgagagcttttagaattgtcctgctttttacatttttctttgctttctttctcaaagtactgttttatgtatgttaaagaatatatacagtcgggctgggcaaggtggctcatgcctgtaatcccagcactttgggaggctgaggcaggcagatcacctgaggtcaggaaaaaaagaaaaaaagacttgattactatgtatatagtatttttttgtatacctacatacccatgataaagtttaatttataaattaggcacagtaagagattaacaacaataactaacaatgaaatagaacaattataataacctactgtaataaaagttaagtgaatgtggtctatctctctctcaaaatatcttattatactttattcacccttcgtatgatcatgtgagatgataaaatgccagcatcactactcgtgccctttggggccattatcaatgaaaacaggagtacttgaacacaagcactgtgacaccgtgagagccgatcagagatggctgctgagtgactaatggggcaggtagcatagaaaatgtggatacgctggacaaagggatgattcacatcctaagcaggatggagcaagctagcaagagattgcatcatgctcctcagaatggtgcacagtttaaaacttatgaattgtttacttctggaattttccatttcatatttttgggccacagttgaccatgagtaactgcaaccacagaaaataaagccttgggtaaggaggggctgccgtatcatactctgcccctatacggctctgccaccaccctctcagctaatgatgtcagaagttatacctttatacattgggtgccaaaaaacatagacttattactggctttttactattagtcttttaaatcatgtataaaaggaaaagtggtgttacaacccaaaatgacaataatactagcttttgtaattgtccatgtatttacctttatagaagatctttatttcttcataggactttgagttattgtctagtgttctttagtttatttttttttaatttttgctttcttccttctgcctatataatggcaaatatcctttaatttcaatctgcagaagtccctttagcattttctgtaagacagatctagtggtaataaactctttctgcttttgtttatctgggaataccttcatttcttcttttctgagggcagttttgccaggtataggattacttttgttttgttttgtcttcttttttaagagacagagtctcactctgtcagccaggatggagtgtagtggtgtgaccatagctcactgcatcctcaaactccttagctcaagtgatcatccctgcctcagcctcctaagaagctgcaactacagttgtgcaccaacatgcctggctaattaaaaaaaaattttggggggggatgaggtcttgttatgttgcccaggctggtcttgaactcctgacctcaagtgattctcccacctcaagcctcctaagtagctagaattacaggaaggagctaacttgtccagcaggattcttgattgacagttttttcttttatctcttcaaatgtaccaacacattgccttcttgctgccaacgtttctgctgagaaatctgctgttaatcttactggagatcccttatatgtaacaatttgtttctctctccctgctttcaagattctctcttggctcacacctgtggctgggtgcagtggctcacacctgcaatccccatactttgggaggccaaggcaggaggattgcttgagtccaggagtttgggaccagcctgggcaacataacaagatcctatctctataagattaattagttagttaattaatctataagattaattagttagttaatctataagattagttagttaatctataagattaattagttaattaattaattacttaaaaattaaagattctctctgttatctgtggtttgggcagtttgattacagtgtgtctctgtgagggcctctttaaattcatcctacttggagttcactgagcttcttggatgtttagattcatgtatttcaccaaatttgagatgttttcagccattatttcttcaaataatctcttattatttatcgattaaaaacaataataatctcattttcttttttcttttgagatggagtcttgctctgttgcccaggctggagtacagtggcacaatctcagctcactgcaatctctgcctcctgggttcaagtgattctcctgcctcagcctcccaagcagctgggattacagacacctgccaccactcctagctaatttttgtagttttagtagagacagggtcttaccatgttggccaggctggtcttgaagtcctgacctcaagtgatctgcccacctcagcctaccaaaatgctgggatgacagttgtgagccactgcacccagccaataatttaattttctctttccctctctctgttctatttctggcaccctgacagtgtgcattcttctacttgatggtgtcccacaggtttcttggaccctgtttactcttcttcagtcctctttctttctgttcctcagacttaatcatttcagttttcttatcttcaagtttgttgattccttcttcggcctgttcaaatctgcttctgaatccctccatgaatttttcatttcagttattgtacttttcagctacagaatttcctcttggttccttcttgtgttcactatatttttattgatctttccattttgtccctaaataatttgcttggctttgtctgcgtccttcttttctctttttgacagttaaacgatttttttttattcatgatcctcctctttcttcttcttcctcatcttcttcatattcttcttccacatttttccaggcaactttagcaggaccctttgtgccatcaaagtttcctttagacttaaagtcaacaacatccttctcatacttctccttcagctttgccgcctttgtgatgtaaggctgcttttcactgtcgtttaagttattccacatctcacccagctttttgccacatctccagtagagatgccagggtttgtggatttggtcttggggaggaattctgaacagaacagaaataatatagaggatggccttttgggggcattaggaaacttcttcttgcctcccttagctggtctgttatcctccatttcccgatcatagcatactttatctgcctttgcaatttcatcagatttagacttctctttcccactgtcttgcacctctcagaggacttcttggaaaattctgcaaaattgacagggacctctgggattttcttctatgtccttctctgcacatctgcacaaagaaggcataagcagacattttgtcctttggtttcctgggatcacgtttagccatcctgactgtattgttcactagtctctatctgcatctttctttagctctctgagcattattagtcagacaaaatgctttgtctagtaagcattaaagacaaagccagccaggtgcggtggctcacatctgtaatcccagcactttgggaggccaaggcgggcagatcacttcaggtcaggagttcgagaccagcctggccaacatggtgaaaccccgtctctactaaaaatacaaaaattagccggaccttgttgcagttgcctgtaatctcagctactcaggaggctgaggcgggagaatcgcttgaacccgggaggcagaggttgcagtgagccaagatcatgtgactgcactccagcctgggcaacagagcaagactttgtctcaacaacaacaataatagcaacaaaaacaaagcctcagaaaaggctgaataagtttcaggccattgttataatgtctttgtctagtaagtttgccgtgtggttcttccttagagatggtttctatatattttttccctatgaatgaacccactttcctgtttctttgtatgcctgtgatttttttgttgaaaacaggattttgaatgttacaatatggtaactgtggaaatcaggttctctcctttacccacgtctgtctgtctgtctttttctttctttctttctttctttccttccttccttctttctttctttccttctttctttctttcaagacagaatctcactctattgcccaggctagagtgcagtgggactatcatggttcactgtagcctctacctcctgggctcaagcaatcctctcatctcagcctcccacccagccaatatttttttttttttgtagagacaggttgtcaccatgttgcccaggctggtctcaaactcctgggctcaagcaatctacctgcctcggcctcccaaagttctgggattacaggtgtgggccaccatgcccagcctgtttttctttttaaattgttgtaaggtgtctctgtgcaggggatgaacttgaggtgtaaacttgagattgtctcgggtcttttctgaggctttgtctttccaggcatgaatggtgactttctaaattctcctgtatacgtggttgcttttgaatgtcctagtccttaattgtttggccactaaaaggagaaaagggaaaaattaagggtaaaaaaataaaaaacaggccgggcgcggtggcttgggcgtaagcctgtaatcccagcactttgggaggctgaggccggcggatcatgaggtcaagagatcaagaccatcctggccaacatggtgaaaccccgtgtctactaaaaatacaaaaattagctgggcatggtggcacacgcctgtagtcccagctactcaggaggccgagtcaggagaatcacttgaacccaggaggcagagattgcagtgagtcgagatcacgccactgcactccagcctggcgacagagtgagactccgtctcagtaaataaataattaagtaaaaaacaaaaaaacctcaaaacccagcctctatctctttcaatgctctggaagctgctttagccagtggggttgtaacaatggcagtcccccctgtgtctgaacctctgcaatcagaagcagcagccagtgatgagaatacacatctcttctgggcacggtggctcacgcctgtaatcccagcactttagggggctgaggcaggcggatcacctgaggtcaggagtccgagaccagcctggccaacatggtaaaaccctgtctctactaaaaatacaaaaattagccaggcatggtggtacacacctgtaatcccagctactctggagactgaggtgggagaattgcttgaacccgggaggcggaggttgcagtgagccgagatggcacctctgcactccagcctgggcgacagagcaagacttcatcttgggagaaaaaaaaaagaatacacatctccagtatttggaggacaaggttatgtgctaaccctgggtgctgcaagctattccaagaatgactgcatgtagggctgaggggctggggaatgcatagccactaccatgagaggacactgaccgaaattaaccaggattcacattcaagctgttctggtttggatatttgcccctttccaaactcatgttgaaatttgattgccattttaacggtattacgagttgggaggtttaagagatgattagggccacgtgtggtgagtcacacctgtaatcttagcactttgggaggctgaggcaggagaattgcttgggcctgggagttcaagacccgtctaggcaacatagggagaccccctcgctacaaaaaataaaataaaaaaattagcaggacatgatggcacatgccagctactcaggaggctgaggtgggaggatactggggcctgggaggttgaggctacagtgagctgtaatcatgccactgcactccagcctgggagacagagcaagaccctgactctaaaaataaaatttaaaataaagaataaaaaatttaaaaattagccagatgtggtggcacacacctgcagtcctagctactcaggaggctgaagtgagatgatcacttgagcccaggatttcaagactgcagggagctatgatcatgtcactgcacgctagcctgggtaacaaagcaaaaccgtgtctccaagaataaataaaataaaataaaaataacagatgattatgccccgagagtggagtgaattaattaatgccattatcttgggaatgcatttattattatgggagtgggttaattatagtacggagaaggctgggcacagtgactcatacctgtaatcccagtactttgggaggccaaggtgggaggattgcttgagctcaggagtttaagaccagcctgggcaacatagtgagatcctgtctctactaaaaataataaaactagccaggcatggtggcacatgcctgcagtcccagctactggggaggctgaagtgggaggattgcttcagcccaggagactgaggcctcagtgagctatgatcacaccactgcactccagtctgggtgacagagtgagactctgtctcagaaaaaaagaagggggaagagttaagccccccttttactctctctttctctctctctcttctctttgcccttctgccatgggctgacaccataagaagaccctcatcagatgtcagctcattgatcttggacttcccagcctccaaaactgtgagccgatggatttattttcttgtaaattacccagtctgtggcattctgttatagcagcacaaaaaggagtaagatacaagccttcccctggaaactgcaggccttcagatggactccagagttccaaaatagttgcatcagacagattctgccagattgttgtctagatgggggcgacagattcctggcactttctactgtgtcatcttccatgatatcactgctatgtaaataattcttacaactcaataataaaaagacagctcaattaaaaattgggctaagcgtctatatacacatttttccaaagaaaatatacaagtggcgggctgggtgtggtggctcacgccaataatcccagcacgttgggagactgaggcaggtggattgcttgagctcaagagtttgagacaagtctagccaacatggagaaaccccgtctaaagaaaaaaaaaagaagaagactgttctccaggctctgcaatgccctctgttgtcaatcaggtatccatgtgtattggtctgcttcggagtttttcttgctggttcactggacgatttttgtatttgtgcactaatcacactgccttaattaccatactttataataagccttgacaggcagtgaggtaattgtcctgacttgttcctcttcttctttttttatttttattttttattttttttgagacaaggtgtcactccgtcgcccaggctggagtgcagtggcgtgatcttggctcacttcaagctccgcctcccaggttcatgccattcttctgcctcagcctcccgagtagctgggattacaggcgcccgccaccacgcccggctaattttttgtgtttttagtagagacggggtttcattgtgttagccaggatggtctcgatctcctgacctcatgatccgcccacctcagcctcccacagtgctgggattacaggcatgagccactgcgcccagcctgttccccttctttaggagagtttttggatattctcattcttttgtatttccatatactatttatttatttatttatttatttatttattgagacaaggtctcactcttgcccaggctggagtgcagtggcgcgatcttggctcactgcaaccaccgcctcccgggttcaagcgattcttctgcctcagcctcctgagtagccgggactgcaaaagcgggccaccacgccgggctaatttttgtatttttagtagagaagggatttcaccatgtggtcaggctggtctcgaactcccgacctcgtgattcgcccccgcccccccaccccgcccccgacccccaccccgacccttggcctcccaaagtgctgggattacaggtgtgagccaccgcacccagcctaatttttgtatttttgtagagatggaggtcttgccatgtttcccaggttggtctcgaattcctgggttcaagcgatccacccgcctcagcctcccaaagtgctggcattacaggtgtgagtccctgcacctggcctttttctcactcttgactttttttttttttttttttgcaattttctctttttctttggtcagtttcaccagggatgagacttttagctttgttgattctattatatgtttgttttttatttcattatttttcctctttattatttcctatcctacactttctttggatttggtttgctgttccttttcaagtttcctgagatgtttgcatagttcatggattttcagcttttcttcttgtctgaaagaatttgtatagaactgaaataatgtcttctttgataatttggtagaattcacctgaaaattatttgggtttgctttgatttccttaaaagtaacagagctattaacgttctatttcttcttgggttgttatgatgataccgttttcaaggaactgattggttttgcataagctttcaaatttattgatgcaaatttgttcactgaatttccttattttttaaatctctgaacatctgtagttatatctccctttgtgttttctaatgcttacccatgctttctctgttttattcttggttagccaggctagagttttgccttttttttttaatgagtttttacaaagaactgtttcttggctttattgatctaattatatctttgggatttcattaatttctgcttactatgtccttttaacactctttgggtacactgtgttcctctttttttaatttatatttatttatttatttatttatttacttatttatttatttatttatttttggagacagggtctccctctctcacccaggctggagtgcaatggctcaacctcagcttactgcaacctctgcctcccaggttcaagtgattctcctgcctcagcctcccgagtagctgggataagaagcgtgccaccacgcccagctaatttttgtatttttagtagagacagggtttcaccctgttgatcaggctggtcttgaactcatgacctcaggtgatccaccagcctcggcctcccagagtgctgggattacaggtgtgagacaccactcccggcctgcattctttttctttattattattatttttaactctgtcacatctcaggatgtgttctttttcttttctttttctttttttttttttttttgaggcagagtctcgctctgtcatccaggctggaatgcagtggcatgatcttggctcactgcaacctttgcctccccagttcaagtaattctcatgcctcagcctcccaagtagctgtgattacaggtgggcaccaccacgcccagctaatttttgtattttcagtagatacagggtttcgccatgttggccaggttggtttcgaactcctgacctcaggtgatccacctacctcggcctcccaaagtgctgggattacaggcgtgagccacctcgcctggcccatagatgccctttatacaaagttcctttctattcttagtttaagggtgtttttttgttttttgtttttatcatgaaattgtctcggggccaggtatggtggctcacacctgtaatctcagcactttgggaagccaaggttggagaatcacttgaggcccagagttcgagaccagcctgggcaacatagcaagaccccatttctaattaaaaaaaaatgtttttaaagaatgagccaggtgtagtggtgcatggtggtattcctagctactcaggaagctgaggcaagagggttgcttgaacccaggagtttgaggctacagtgaggtatgcctgtgccactgcactatagcctgggcaacagagctagaccctgtctctaaaaaaaggtgttgcatggccaggcatggtggttcacgcctgtaatcccagcactttgagaggccgaggcaggcagatcacctgatgccaggagttcgaaaccaacctgggcaacatggtgaaaccctgtctctactaaaaatacaaaaattagccagtcgtgatgccacgtgcctgtaatcgcagctgcttgagaggctgaggcatgataattgcttcaacctgggaggcggaggttgcagtgagccggatcccgccaatcccgccactgcactccagcctgggcaacaagagcgaaaaactccgtctcaaaaaaaggtgttgcattttgtcaaatgctttttctgggcctattcatatgattatattgtttctggccaggcgcggtggctcacacttgtaatcccagcactttgggaggctgaggtgggcagatcacctgacgtcaggagtttgagaccagcgtggccaatatggtgaaaccccgtctctactaaaaatacaaaaagttagccaggtgtggtggtgggtacctgtaatcccagttactcaggcagctgaggcgggagaatcacttgaaccccggagatggaggttgcagtgaaccgagatagcgccactacaccccagcctgggtaacaagagcgaaactccgtctcaaaacaaaacaaaacaaacaaacgaaaaacagagtcaggaatgacagtgtgctgctcagggccaggcctgaggaatggaagacagtggcaccatcacacacacacacacacacacacacgcgcgcgcgcgtgcgcacacacacacatgcacacacacgcgcgcgcacacacacatgcacacacgcacacacatgcacacatgcacacacatgcgcacacacgcgcgcacacgcacacacacgcacacacacgcgcgcacacagacacacacacatgcacacacatgcacgcacacacacacatgcacacacacacacacacacactaagtccttttaacatttcaaccctaaaattgtaatttttaaaataacatgcttataaaaaaagaatctcttccaagtaggtttctgttaaaaacagggggttcaggaagtttagaggtgttgttgtttacgtgtttttttttgttttttgttttttgctttttgtttttttttgccttcggtgtagattggaggatttgctttaacagaatatctttttggctttactggctaaaatagccagttcctgcttattaatactcaaacacatcaattattcatctgcacttgggtatattacacacgccgaatcatccatcctcctgccctctttgttaaaggaggctttgaggccagcagccccacggggaaggcgtatagttgggactcagggctgactcagagggccagccctggccagctcatgtctgaggtcacatccgagggagaggaggcagcagagctgagtgaacagaatcttgttctaacaacttcccaggctccacactgccttgccatgctgagctgtccatgtgaggtcagggatttgtcaagatgaagggctagacctttgagggttttgctctttcaactctgctcttgtccttgacctgaaattatactagcggcaaaaaaaaaaaaaaaaaaaaaaaaaaaatgatgacagctgatgtgtgctggggaaaatgatggacagtcagaaccattgtgatcttcagatgaggaagctcaagttcaaggtgggaaggaaggctataggcaaggccgcttggcagccaaatgcaaagtcacggtagaatctccgtctcccggtgaccatcccccatcagcctcctgcatggaacccataacgagggccagaacagtgaagggtctgctgttagctatgccctggtgcactgactcccaggtaaaaccagatccacagaggagaagggagtgaggattatttatttatttatttgagatggagtctcactccgtcacccaggctggagtgcagtagcatcatctcggctcactgcaacctctgcctccccggctcaagccattcttgtgcctcagcctcccgagtagctaggattaccggcatgtgccaccacgccctgctaatttttgtatttttagtagagacagggtttcaccatgttgcccaggctggtctcaaactcctgggctcaagcgatctgccctcctcagcctcccaaagtgttgggattacaggtgtaagccactgtgcccagccaccactaccctgatttttgtgtttttcatccccttgtgtttttttcaatagtttcattctatacgtttgcatctttaaacagtatgttgtttggttttgcacgctttcatttctgaatcacgctatgtgtattctaagaattgctctggttttttaaataatatctcaagattatgatactgagatgcattcacattgtgtgtagctgtaaaaattattctctctgttatatactatttctttgtgctaatatgccattttctgtattcgtacggataatggacatttgaattgtttccagtgtgtttctataacaaactgtagtgttacgactattcttatacatgttcccgtgcatatgtttgagagttgtttttttttttttagaaactgatgtctattttccatcaaccttatttccatgttgctgaagagcccgtgcaagaacagcttaagactattcagtggttgctcctaccccttcagtggcctgagcagtgggagctgcagaccagtcttccgtggcaggctgagccctccagtcttcagtagggaacttctgaataggcacagagggcacctaaacgccgtcagaccagtctgcaacctcaggctgagtagcagctgaggagctggagcagtccattcaccctgaaattcctctttcgtctcagccttttcagcagcagcctgctcttcttttttaatctcttgaggatctctgtagaagtagagatcaggcatgacctcccacgggtgttcacgggaaacggtgccacgcatgcgcagaacttcccgagccagcgtccaccacatcaaacccaatgagtgagctcccttgttgtcacatgggatggcaatgtccccatagtgcagaggagaatctgtgttacacagagcaatggtaggtaggttaacataagatgcctccatgagcggccggtggtcagccctggggtcagtaaccacaagaagccgtggctcccggaaggctgcctggatctggttagtgaaggttccaggagtgaagcggccagcaactggagtggctccagtggcagcagcaaacttcagcacagccgtctagccagtattcctgaatgatatggcactaacatcagcagggttttcaatggcaacaatggcacgagctgccagcagaagcttctcccaggtcctcctcagatttatgatgtagatgccatcacttttccttttacagatgtactgttccatctggaagttaagcttggtgccacctaagtgggttcctgccacaaggaacttaaggacatgctcctccttcatttgcaggacatcaaaagctccggaccttgtgaaagtttccctttaagttacagtgagaatccagaacaacgccgtatggacccctctgtgggtagcgcggaaagcgggagtttctgtttttttctctttttttttttttttgagatggaatcttactccgtcacccaggctggagtgcagtggcgccatctcggctcaccacagccaccgcctctgaggtccaagtgattctgcctcagcctctcgagaagctgggattacaggcgtgggccaccatgcccagctaatttttttgtatttttagtagggaaagtgtttcaccatgttggccaggctggtcttgaactcctgacctcaggtcatccacgcctcggcctcccaaagtgtgaggttataggcatgagccactgtgcccagccgagagtttctttagggcaaatattttgggtggaattgctcagttgtaggggccacacaacttcaactttaattgctaatgtcagattgttgtccaaaatgtcaattttactggcttttgccaaagaactaagttttggctttgttgagtatgtgatctttgcactgtgcttcactattttctgctcttaccttgaacttacactcccaagcagggtctaagagtgcccactgaagccaggggcagcagctcatgcctgtaatgccaacactttgggaggctgaggctgagaattgctcgagcccaggagtttgagaccagcctgggaaacatagtgatatctcatctctacaaaaaacaatttaaaaaaaattagccaggtatgatggctcatgcccatagtgctagttacttgaaggttgagacaggaagattgctggagcctaggagttcgaagctgcagtgagctatgatcatgccattgcactccagcctgggtaacagagtgagaccctgtctctaaaagacaataaaaagttcccattgttccatattctcagcagcacttgatattgtcagactttttcatttttgccaatctggtggccagtacatggtaacttattatggtctttgcgctatagattgtttgtgtccatccaaattcatatgttgaaaactaaaccccagctgggcacagtggctcaggcctataaacccagcactgggatgctcagattggaggatcacttgagcccaggagttcaagaccagcctgggcaacatggtggaaacccgtctctacaaaaaatataaaaaaatttgctgggcatggtggtgagtgcctgtagttctagctgcctgggaggctggggtgggaggatcacctgagcctgggagattgaggctgcagtgatccatgatagccccactgtactccagcgacagggtgagactctgtctcaaaaaaagaaaactgaaccccagtgtttgatggtatcgagaagtgaggcctttggaaggtaatgaggtcaggagggtggatccctcctagaaaagagccccagagagctcattcgccccttctgccatgtgaggacacagtgagatgatggctatccatctgtgaacacaaagccagccctcaccagacactatgtctgccagggccttgatcttggatttcccagcctccagaactgtggagaataaatttttgctgtttttaagccacccagtctacggtagtttgttatagcatccaaaatggactgagatagcttgcatttgcaataacagacgactttaagtatttgttcttattatttatcaacccccaagtgcctgttgttgacttttgcctatatttctattgggttgttgatcttattaaattatagatctttctttctttctttctttctttttctttccttgtaatggagttttgctctttttgcccaggctggagtgcaatggcatgatctcggcgcactgcaaactctgcctgccaggttcaagtgattctcctgtctcagcctcctgagtagctgggattacaggtgcacaccaccacacctggctaattttgtatttttagtagaggtggggtttcaccatgtggggcaggctggtctcgaactcctgacctcaggtgatctggcctcccaaagtgctgggattacaggtgtgagccaccgtggccagccaattatagacatttcttatatggtatggatttaaatccttatcagttataacttctcccagtttgaggcctgcgtttttaccctctttatggtgtttttgaaaaacataaactgttaaaaaagctttaactgtgtattcctttgcagctttttattttgcactatgtgtactgaggaacaaaagaaaaaaatgaaatttgagaccagacgtggtggctcatgcctgtaatcccagcactttgggagaccgaggcaggcagatcacaaggtcaggagatcgagaccatcctagctaacacggtgaaaccctgtctctactaaaaatacaaaaaattagccgggcatggtggcgggtgcctgtagtcccagctactcgggagtctgaggcaggagaatggtgtgaacccaggaggcggagcttgcagtgagccgagatcgcgccactgcactccagcctgggtgacagagtgagactccatctcaaaataaataaataataaaaagaaagaaatttgaattaaaaccaaagagcttagtctgtatcaccctcccctgattaaatttttaaattacagttctcctgtcctgaaattatattatgcatgagttctgctatgtgtgtcctgtgacctgagagtgggcaagaactttctctgttcacagctatgtcctcaatgcttcaaacatagctttgcccaaagtaggtgctcaataaacactgtggatggaaggaacaaaggaaggagagaggagtagcggggcagccaccgaaggctgatgtggcttttcatgactccacccagtgaggcccaactggctccaagggtagggcagcagcctaaggaatggaggaaatggtctttcctcaagcagagcttagactttattgtcttggaaaaacctgtttgtatttgggagatgtgcttactttaataggtcaaccctgcaataatgggcaggtctgaggctccaggagtgctggggtagtctattcacccccttattctttctctctatccttttttacccacctgccttgcagccagtgggtgtcagagccagcagcagactggagtctaagggcactgctttctgtccgtgagcttgagaaggcttcttgcccttctgaatctccaagtccttgcctgcaaagcacaggcaatgataaaaacactaacgccttatctggtgttgcaggatcccttaccaagggcttctacgtctcctatcgtgagctcagtactcagtgaggtaggcaaaactggaggaggaaaccggggaggaggagtgagtctctaactccccacgctgtgtggcctaataagccttgatctgtgttctacagactctgagctctgtgctcctctctggggaacaggtggaaagggcagccctccaggaggtggtgagtcctctgagctttggaagggtggactctgcacctgctgcgctggtgctctctgggaattttctccacggacctccagagcaactgtgagtggtagctgttaccattcccatttgactggttcagaaaccttgcctgagggacatgaagtcacttgcccaaggtcccccagcattcagcgtcatagtcagagttcaaactccaaagcccttgcctctgcctcaccactgtggtctccctagacctttagatatagttccagacagtgggttttcccagctcagagcagagtgggtcatgggacagggcaggctccagagggctacgctaccagaatctggtaatgacaactgtgtatgtgtgcgtgagaggcggctgaccgatctagatggggactgaccgatctagaactagatggggatcaatcatcttcagcagatccgagagctggagaattactgcaggggcaaatggctctttctctcctgcatcccccagggccatctctacactgcggtgaagcatgggacgtggtaaaaggacacctttgagctgtgggaaaagctgacacgatttttcagaatagtgtgtttaggaaggcgggggcgcccatgttcttcccgagaggcgttccatccagagctatctggaaaggctggggtactggaagccagaaggtggagaatcactgatgcagctctactgagttttcagctgggccccacccacactgacctaagcacaggaggttcgagggctctccactgaccaggaatgaaaggatcaattgcagagtttcggccttggagcccagtcctggctctccctttgcttgctcctgacgttggaagagttacagcccctcctgagtctcagtcagtcgcctctcacgtgcccattgacgtctcacaggctgttggagagttagggggtcctagcataggtgtcttgtgccaggtacacagctggagctcaataaatgtactgtgacctcaggcaggaaaagccaaggaggggcgggccaccctgggggctggtctgcagagtcttcagggaagaagccaggacaaggacaaggaccctggatgaggacaggatgagaggatggctgcataacagcagggaggctttgggcaggcaggggagcctttccaggtgagtgaatggcaggaacacaatcttggaagtgagaattcctggggtgccttctgggccttgaagcagggctcacagagggcaacaggaccccgctggagtgaagaaggggactggagggtaaattaaaagaatagcagcttgtctgccctcatccccggtgtggggggagcagcctggcatggagtccaaatggacctcatatttcccaaagactcaaagcatctggggcctacctggaatgtcccaggaacacctactgcccggcccctcctctttcccctcaccaagcatgatgactgcaatgtctcataattatcacactctgcttttctccatctctgtggctttacatattctcagtgttcagctcttggtctgcaacatatctgcgtacaaacacgcacacacacacacacacacacacacacacacacacacacacacactgaggaatggctcccgggtcccagtagttcccactctctggtagaggagttgtgtttgtgagggctgtgatggggtgacaagcctgcagcagcctttccatgttcgtccaaactagatgtggtgcagagagcacaggcctgtggatcagcagatgtgacacttagcatgatggtactggttaggatcaagctaggcagtaacacacaacccaactgtagtgggtgcaacaagcaggtgcttatttttttgcagaagaaatcaggaggatggcaatctcactgctagtgcaggtgcttgaagctgccatcggggacccagatactttctggtgatagtgtatatggggggcgtctgctggagcttgggagatttggacccccattctggctctgttgctaactagttgtgcagcttcagacaaagcttctgaagctttgacttcatttctttatttgtttttaaaattgcaggctgagtatagtggctcctgcctgtaatcccagcactttgggaggctaaggtgggagcattgcatgaggccaggagttcgagaccagcctgggcaaaatggcaaaccctcatctgtacaaaaaaaaaaaaaaaatacaaaaaattagctaggcatggtggtacatgcctgtggacccagctactttggaaactaaggcaggaggatcacttgagccccgaagtttgaggctgcagtgagctgtgattgtgccacggcactccagcctgggtgacaaagtgaggccctatctcaaaaatgaataaataaaattgtggtaacaacatataacataaaaccatcttaaccatcttaaccatttttaagtgtacagtttagtggcattgagtacattcatactgttgtgcaatctgtcctcatgtctcttttctttccaaacggaaactctccctattaagcaagaactctctatttcctcctccccactggcaccaccattctgctttctgtctcaatacatttgactgctccaggtaactcatagaagagggatcatacagaatttgtccttttgtgtttgacttatttcactcatcataatgtcctcaagtttcatctgtgttgtagctaatgtcagaatttcccctctttttaaggttgaataatattccattgtatggacataccacattttgtttagccattcatctatggatggacacttggtttgctttcacattttagctattgtgaataatgctgccatgaacatgactgtgcagatatttccttgagactgtgttttcaattcttttgggtatctatctggatgtgggattattagatcctatggtaattctatttctaatttttttcaagaagcataatactgctttccatagaagctgcaccattttacatccccaccaacagtgcacagtttccaatttctccacgttcttgccaaaatttgttattttctgcttttttggtagcagctatcctaatggctttgagactcagtttctcgtctgtcccacagggacatagtagggctagattatctctagcttctgatgtctcatggtgccttccttcttgccatgaaagtaagtattgcttatgcacatatacatcttagtaaatttagttatatcttttcagcttggggccccaaggtagaaactattttaatatgaagacaggaaacaagaaatatgaaaagggattgaagaaggcattccaaggacaacttccaaaccctcctctctattccttccagaccatagatgcacataattctgggccacagagagtcctttggacagaacaatactttactgtttcttctcttcctctccttttcttttttgcttgtaattcacacacccaggtggctaggcgcagtggatcacacctgtaatcccagcaccttgggaggcagagatgggagggttgcttgaggccggaagttcagtctgggcaagacttggtctctaaaaataaattacctaggtatggtggtgcatacctgtagtcctagctattcaggaggctgaggcaaagaatcacttgagccccggagttcaaggctgcagtgagctatgatcacaccacagtgccccagcctggacaagagagcaagaccctgtctggctcaagcaacaacaaaggaaggaaggaagaaggaaggaaggaaggaaggaaggaaggaaggaaggatggatggaagggagggagggagggagggaggaaggaaggggaaaaagagagaggaagggagggagggagggaggaaagagagaaaaaggcaggcaggcagggcaagaaagagacaaagagaaagaaagaaagagagaaagaaagaagaaaaaagaaacacacacacccatctcccactctttatagtgtcatgatgtcatttaacataagtgcaaggaaaagttcaaggcgtttaattctagcttttacaaaacccagaagcatcttgagttaagtactattatcttcatttcctaacttttggcattcgctgactcattatttcatatgtggcttgggtgagaaaagcatctgggtggcaacctcctcccccagctacttctctggccaatggggactgttctgaacttcccatacactttctcgcagcttctgcctgaggctgaaaccctttctggggtgttttcccaactgtcatcaggatgggatgcagaaccaggtgccatgctctgtccaaaccctgcctggctccggccttctgcagtctcacttctcaccgctcactctcctgatatttacccagacccaccgtgtggcttctcattgcggtgctcatcaggccatccttctgcttgaactgtcctttctacccatcctcccacagctaactctgctcatgcttttagactcagcataaacatcctctcccccaggaagccttccctgatccaaacccccgagttgagctaaatgtccctgcttgggtctcccacaacacttatgctcaccccgtcttatcataaccaacattgcagttgaagtgtgtgaagcacacatttaactaatggaattccactaactcctcttggccagaaggagaaagagaataactttatttatttatttacttatttatttatttctgaggcatgttcttgctctgtctcccaggcaggagtgcagtgggcatcatccttctgccttttttttttttttaagtttttgtagagacaaggtctcactctgttgcccaggctggtctccaactcctgggctcaagtgaccctcccacctcaggcccccaagtagctgggattacagatgtgcatgccgtctccctattcacattttattttactttattttgttttttgagacgcagtcttgctctgttgctcaggctggagtgcagtgggctgatcttcgctcacttcaactctgcctcccaggttcaagagattctctcacctcagcctccttagtagctgggactacaggcacacaccaccgtgcttggttaattttttgtattttagcagagatggggtttcaccatgttggccaggctggtctgaaactcctgagctcaggcaatccgcccacctcggcctcccaaagtgttaggattacaggcgtgaaccaccgcgcccggcccctattcacattttaaatagaaccactcttggccccctgaccactcctctctgagggttagatgggagccctgagtgttaccttagtcctcaggtgttttaacattgggagcctctggcctctctgggagtgaatctggcgtttaaagatacatatatttggccgagcgcagtggctcacgcctgtaatcccagcactttgggaggccgagacgggcagatcacaaggtcaggagatcgagaccatcctggctaagacggtgaaaccgcatctctactaaaaatacaaaaaaaattagccaggcatggtggtgggcacctgcagtcccagctactcgggaggctgaggcaggagaatggcgtgaacccgggaggtggagcttgcagtgagtggagatcgcgccactgcactccagcctgggcgacagagcgaaactccgtcccaaaacaacaacaacaacaacaacaacaacaaacatatatttcgtggagcaagaaatgtctcaaacatagcaagagagttgggatgccaacggaccaaagggaaagcaagcatgacatagccccccactacaagggcttacctattatccaagctttgggagctaggttagaatcccagctctgtcgctaaccaacctgtgtactttagccaagtcactgtacctgtctagacttcggatcgcatgtgtgtctgcccatctcatagggttaccctgaggctaaatgaggtaacaaatgtcatgaacccacaaggtagactcgactctcggtaacagttcgtgtcacccccatctcacactactctccctcttcggaccctgcacccatggattccatccaccgctggccaggagctgagtagaggcaccgagcacgtgaagaggtgaatgggcaaggaaggcttccaggtcaggtagcatttccagtgttccagcctgcaggcatctaccgagcctggcccgaggctggcacccagagatgcttccagtcttccagcagcaacgcactgactgtaagaaaagcctgcttataaaccccctacaggcatttggaagctggtccctggggtcctctacagattcatttcgcccccaaacccatcccctttgtgccaccctcgttattgcactcttccatccggatggcatttagctgggtccgggtctgtcacccgtctgaccaccagctccttgagggcaagaggcgcctgctgccctcagggtccgcgcccagcccgcagctgctcagatccggagacgggaaggtttgttggcgagaacctgactcccgggtcacagttaaggatgcaagagcccggcgccttcccgtagccccggccctgtcattaattaatgctggggctccattcggtgcagcgcagtcccagggatgcaaccgcaacttttgcgcacaataggctctcgatctgtaatccagccaacccaggcctgtagtgtgtaaatgccaactcagcgggagggctctggctgtcgcccagagccgtttctcggctctttcgcggttgccggcgcgctcgggacaggaggaacccgcagcccgcgggagtcagcggagacccgaccagcactatccagccctctgcaccgcccccgcggcgaggtctggaccaagtcgcccctagcaacaacagccgggccggctttctcaggccatgctgattggcgggactccgggtggcggcctgtcgtcacttccggcagccggaggcagcagaggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaacgtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagttggttaaacattttgaaaagcagatgtatagtgaagctctgctctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgactatattctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgccgcttgtttgctggatagctgtttgataatttaatccgtaaacgtaaaccatagcctaaagcatccctgtagcatattagtatacaatatttaatgctctgtggccctgagtaagtagaacagtgatgtacctttctccacctgagatagattagaaaattatataaagagtgagtaatagaaactcttagactaggtgagtcagggaactaatttccttatagtccttttaaagaaaccttatttatttgtttatttatttatttatttacttatttattttttgagacagaccgagactgtctcccaggctggagtgcagtggtgcgatcttggctcactgcagcctccacctcccaggctgaagtgattatcatgcctcagcctcccgagtagctgggattactggcgtgcaccaccacgcccggctaatttttgtatttttagtagagacagggtttcaccatgttggccaggctggtctagaactcctggcctcatgtgatccacccgcctcggctccccaaagtgctgagattacaggcatgagccagtgtgcccaactgattagttttgatcattgatcttcactcagagaagcaaaaccttacattgaaccagagtaggagctccatgctttctaaactgaagccaaaaacagtcatagcagatttgtgataatgaaggatttcaaatgggtcttttttctttctttcttttttgagatggagtctggctctgtctcccaggctggagtgccgtggcatgatctcggctcactgcaacctccgcctcccgggttcaagtgattctcctgcctcagcctcctgagtagccaggattacaggcatgtgccaccactcccggctaattttgtatttttagtagagacggggtttctccatgttggtcgtgctggtctcaaactcccgacttcaggtgatcctcccgcgtcagcctcccaaagtgctgggattacaggcgtgagccaccacgcccagccatgtagtgtatttaaaatgaatttttgactttttttaaaaatcaagtttatcacacatcgttgcattaatttaccatgccctgttacatttttaactcttgcattggcatgttctggaaggagctgtgtagctttcacagtgtggagcccttgtgtcagtgttataactcaggtatagtccatattaattacctacattactgcactgctaagtattagacttcctgccaattgagtggtgaatgtacaagaatgaatgggagctctcattctgttgagaaccttttttcttaaagttaggtttgttgagatgtaatgttcatctgttttaagtatacagtttggtgaattttgacaagcgtatagttatgtaaccgctatcacaatcaagatgtagaacacttccattgccagaaaggtcccttatggccctgtatagtcagtgccctctccctttcttagcccctgggtaaccactgatctgctttctgtccctgtagttttgccttttctaggatgctatgtaaatggagtcacagtgtaaataatcttttgtgtcttctttcacttagagtagtgcttttgagatttatttgaatgtgtatcagtatcagtagttcattcctttttattgctgagtaagtatttccttgtttggatgtgccacaattttttttaatccactcaccagtgatggacatttttggctattgtgactagaacagttttcttttagtattctgtaaaaatactttttattgtgcttaccccaggaatcttatttaaattttaagtaattgtatataactgtgataagaatgtcgcttattagatcaagactaagaaaaggcaggccgggtgtggtggctcatacctgtaatcccagcactttgagaggctgaggctggcggatcacgaggtcaggagatcgagaccatcctggctaacatggtgaaaccctgtctctactaaaaatacgaaaaattagccgggcgtggtggcaggcacctgtagtcctagctactcgggaggctgaggcaggagaatggcatgaacctgggaggcagagcttgcagtgagccgagattgggccaccacattccagcctgggcgacagagccagactccatctcaaaaaaaaaaaaaaattagccaggtgcggtggtgcatgcctgtaattccagctactcaggaggctgacgtgggagaatcacttgaacacaagaggtgaaggttgcagtgagccgatatcatgccactgcactgcagcctgagtgacagagtaagactctgtctccaaaaaaaaaaaaaaaaaaaagcagacaacttgcaacattatcttcatccttgtacactaatttgtttttgtttgtttgatttccaaatattaatgtccacccttagtgaatgggtatataaaagtttactgttggccaggtgcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggccgggcgcggtggctcacacctgtaatcccagcactctgggaggccgaggcgggcagatcacgaggtcaggagatcgagaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctgcatcgtgttatagctcaaaagaactactcaatctgatccagtgaggttgctgagactcagagaggtgacaaaggctgctagtaatgacagaagaccactaactatttagtagcaaagcctctactgggccccagatctctagcttaggctccacaaggagatgtagttgtacctgtacatagagtatttctaaaacttttttttaagcttgtagatcaggggtgtccaatcttttggcttccccgggccacattggaagaattgtcttgggccacagataaaatacactaacactaacaatagctgataagctttaaaaaaactgcaaaaaaaatctcacagtgttttaacaaagtttatgaatttgtgttgggtcactttcaaagctgtggtgggctgcatgcagccctagggctgtgggttggacaagcttgctgtagattttattttgattttgagacagtatctcgctctgtcacccaggctggagtgcagtggagcaatcacagcttgctgtaaccttgacctcttgggctcaagcaatccttccgactcagcctcctgagtagctgggactacaggcgtgccccaccacatgcatggctaatttttaattttttcgtagagatgagatctccctgtattgcccaaggtggtctctaactcctgggctcaagcaggcctcctgtcccagcctcccaaagcactggaattacaggtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacattttacagtacgtaggacagccttccacagcaaagaattacccggcctaaaatgtcagtagtgccagcgttgagaaaccctggtatgtacttagccccccatgtactcaacagcgcagctcagtggccaatcttatttcatttataaatgaagaagcaaatgcagtatcatttcctctctaaagcttttagaagagataaagcctgttttaagaaaaaagcaatacttttatcatattttcttaatatcaaatatgcagtatttaaattttctcacatttctaatttttaaactgttcaaattagaatccagcttgaattcatacattatagttggctgatatgtcaaatatgctttttttttttttttaattgagatggagtcttgctctgtcgcccaggttggagtgcagtggtgcaatctcggctcactgccaacctctgccgcccgggttcaagcgattgtcgtgcgcagcctcccgagtagctgggattacaggctcccgccaccatgcctggctattttttttttttttttttttttttttttagtagagatggggtttcgccatgttggccaggctgttctcaaactcctgacctcaggtgatccgcccgccttggcctcccaaagtgctgggattacaggcgtgagccactgtacctggtcaaaatatgctttttaaaggcaaccaaacagtttgcatttcagtttatgttctatagttatatggagccacggatacatcctttttctatactggcaaaatgagaaacatatttttcacctgaatttcaaaggatatgacacttcgtaagcctggtaatgttattggccaaagtaccagaggcccagggctttcccagttatttaacagttactgatatgtgtgcatcatgtacttattattagttaatgcaaatagtcccccaaatttctgacctctgtgaaactgatgatgctgttgtctagtcagtcatcggttatgtgagactgaattaacctattcagcaagtgtgaatgcctaccgtgtgtatgatactgtgctaggtgctgtagaggccatatacctgggacacatagctttcctgctctttaggatttcctgctccttgcaggacaaagcagcctgagctttatgaaactagtctgtaactctcaaacttaagcaaacattagaatcacctgaagggctttagaaccgtgatcactgggccctacccctagaccttgattttacccgtagaattggaatttctaacaagttgccaggtgatgttgatgctccaggtccggggaccactcttaagaatcactatagcaggaatttctgatgtttatttattaagaaaaaaaaatcactgccttagtgtgcagtgaaggcttgctaactaaactatactccttttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctccgcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggctgatctggaactcctgacctcatgatcctcccacttccctcctcggcctcccaaagtgctggaattacaggcgtgagccactgtgccccggcttaatcagcttgtcaacttctaagcacaacctgttgaatcaagctgtttgggccttatcagaaaaaagttggcctatagtttcagctactcaggaggctaaggccagaggatcacttgaggccaggagttccagtcgacctggacaacatggtgaaactatgtatcttaagaaagaaaaaaaaaagttgatctctgaagaattcatgaaaatatttagtcagttttcagggaaagatcttatagacttcaatttgagcatccttatcttatgtatgtaaatgaggtaaaggttgaaatttgcagtaaatagaattttggtcatttaagttatgtagctcatgatatatacattgtataactatttagacttacatggtgcatgatttacattgtaattacatagaggcttatacagtctaataaaaattaatattaactatttgattgcaaagaggattgttctgcattttattactttttttttttttttgagacagagtttcactcttgttgccaggctggagtgcaatctcgtgaccttggctcactgcaacctccgcctgccagcctaagtagctggggttacaggcacacaccaccatgcccagctaattttttgtatttttagtagggatggggtttcaccatgttagccaggctggtctcaaactcctcaccttgggttatccgcctgccttggcctcccaaagtgctgggattacaggcttgagccactgcgctcggcctgcattttattattctaagatatagccaaattttatgcctggaattttttcctgggctggaacaaattcctagtaagagtcagggaatattccgtgacttgtggctttggttaaaaaagaaaaaggagtcagggaatgcagtaccctctgatcaccactgggaggactaaagcagaaaattcatttgtctcatatccattttcaaatttcaaattaaacatgaaggagaaaataaatctcttacctgggaagctttaatgtcctgtctcacacaagaagttaaaggttgtgcttggagttggtctgcaaaagtaataaggaatttgtactcacccgtctgcacctgcttgtacagaacaattggaagggcagaagttggctttgaaagaaaaggcctttttttggaggtgggaggggcatccaattttgtcttcagccgagagttcgctagcactacactctagccactcaagctgctcaactatggttggtcttgtgtacttctgtgtgcactagataagacattgtttctgtgggttatgtgggaccttgaagttcagtgttgaagctcaaacaaagcaggtgttttttctgtatttcttgttgacaggcatttgctttttgttggacctaaatattgtggggtttgtgtatggacatttgacacaaaaatctgtattggtagaatttaatataaaatcagagaagttgaattcacaggttttgttcatagaattttacataactctagtcttttttctttttttgtgatggagtcttgctctgttgcccaggctggagtgcagtggcatgatcttggctcactgcaacctctgcctcctgggttcaagtgattgtcctgcctcagcctcccgagtagctgggattacaggcacccgccaccacgcctggctaatttttgtatttttagtagaaacggggtttcaccatggccaggctggtcttgaactcctgacctcaagtgatccacctgcctcggcctcccaaagtgctaggattataggcatgagccacagcgcctggccacaatcttacactactttcctgaagggatgtgtgatggaaagagtctgggcttgaaagtggaagacaaaaatgagagtctaagactgatcgagataaagattctgaagaggtagaatggacctcataagatggagcaaaaaagaaggaacaacatataaaaggagaaattagaatttagagttatagactggaatttgaaactagtcttgagatttaactgtggacaaattcactcggctgtgcctcatggtttttttttttttaaatcaaaagagaataacatcattcaagttgtgtcttggtttttttgtttgtttacttagatttttatgacttcactttctcaatttcctctgtggccagattcatcaggcattcagtcactttcatctctgtcaggctggccttgtgttctgtctgtctgttctgctgcatagttgtcatcctgagatctcccttcacccatatcctagggattccctttgcctttcctgttcgatccattttcttccccttggttcactcccaggtttcattgcagcagttcctccagtgattttctgagaaagttgctcagaggtaaatttttaaaatcctttcatatctgcaaacatctttattctgttctcatacttgattgatattttggctgcatatagaattctagactgaatgccctttttcctcagaattttgttttctgtcttatatagcatctgacactccgatttggagagagagaatgctattttgagtcttgcttatttttctgtttgtttaaggctgattggaagttttgtgcatttggatggatcttgaatacaacagtgggacacactgttatttctttgtggtgctcttgataccaatatatttagtcttatcacttggcctaggcaagcacggaatgcccatgttccagggagctgagtcgggagagggcagaaggaaagatctgtggctttctgctttctctgcttgttttcagtgtccctgccctcagttgtgccctgtgtccccaagcccagagactttccattttgccctttctaaagaacctccagttttttgcctgagtgggagaggagacccgggggtctgttatttaacagactgatagatcttcttgtttcaggcttacttcactcacacttctagaggtacttgtactaccagttcctgaaccttttgagagttctataatacaaatcaggattttccaatatctccatagctggcttaggattaatctttcttatatgtgttaagtcattttccttctttttttagtttctgaaagtatatctgttaccacttttattttctttgtcttgtggcttttttccttatgccttatatttttttcctttactttcatattaatggagtttggagagggaggggaagtaaatgcagccatgatttataaccagacttggattaggtgtttacatatgtcaatacatgtctttaaaatttagctagtacttgttattataaataacaaactaagattgataggcttcttgaaaaattggcggtaaatttggctaatggtgggttgttgtagtagagtagcgtttccccttttcacccaagctttgttacctcttcttgggtggtgcctggcctgagatgtccttcatctctcataagaactctcctacttgccctttgaggactccatcccttcacatcttggggtaccttttttccttcatctcacccaaatgtgatcatgtcctttgggtgcctagagctgcattatccagcacagtagcaactagccacatgtggggctaccaagcacttgaaacgtggttagtttgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacagcattagagtattcactctgattttctcttggggcaggaattgccccttgtttcagttgctattcccccgttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaagatttttttagccacaacttgtgccttacaagttttttattctaaggattagacaagtaaattatttttcaccgtattacattagttcacctactataccagtaacaattattttattcaaaagtgaaacagattttactatatttatgggacaataacagttcccccttcctattcatattcttagatgctttctcataaattcagctgtgaagagtcacattatctttgatccatgtgagactatcttcttgttttatctactcctgttagtctccatatgtcattactcttaccctccaccccacgttactgttttaatgtgtttagtatgtgtatgtgttcttacatagtttattttggtatgtttggtactttatgtaaatattacatatgtcttatctgtgcgcttaatatattgcatctaactgctgaatagcagtgagatgtatgcatctaccacattttaccagtctgctcgccagaggtgcacatgttaattttctccaactctgtcaccacaaaaaaaatgcttcaacatcttcatgcatgtccccttatggagcaatgtaagagtttctttgggatatatagcttggaatggacttgatgggtcacaggaaatgtcagattgttcttctagatggctgcttccatcaatagtgcaccacagtttttgtattcccgtttctctgccaacatttcagagctttctgccttttccctatctaacaggcctaaggtgatactacattgtggttttaacttgtatttctctctgatttttagaatctctttatacattccttggctttgggtgcattcttgttttttgcgggggttggtgatttttatcaaatcaaggacagacatcccattctaatcctagtttgctataggaattttgtgggggctttttggtagagacagggtcttgctatgtttgcccaggcgggtctcaaacttccgggtttaagcaagcctcttgcctcagcctctgaaggtgctgggattacaagcatgagtcaccatgcctggccaagagtttttaaattataaattgttcaatcttatcaaatcctttttctatgttgaatgaaataattgcctagctgctttcaaaagtgaaacgtgactttgtgaatatttctaaagtacaaaatacttggaggacagccatttattgtcacaacttggctttgtagtttgtttttgtttttgttttttaacatttggaaaccatacctatgtgttaagtaagtggcttgtgatttaaggaatagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaattttttacggacttcctgccggcaaggatttttttaaaagattttttaaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaaagaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctccccttttatgataaacaaaggcattaccaacccctaccccctactacattgccacctagtagactttaactaatgagaactggccagaactaagccagatggctatctctagctgcagagaagtttgggaaaacaagtatttggccaatgtggtctccctaaacacgtgttcaacttcttgaagaaggaaatctcatgtctttggctgtattcagcatttttcagtagcagttacatattctagttttcatggtggatgaagtggtaccagcttagttccacaggagggagaagaatcaggactcatttaatccataagaattaaactcagcagcttttgagtacccattatgtgcatagtctgccatgaaatattataaagtagtccaggtatggtggcttacacctgtaatatcagcactttgggagaataagacaggaggattgcttgaggccagagtttgagatcagcctgggcaacatagtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaagttatcaaagaattatataacattttgtgtgtgtgtgtgtgtgtgtgtgtgtgtgtgtgtgtgtatgcaggttgtttattggctccttaggaagaaaaaaatacgtgtatgaaataattgattaacagtacaagaactcataattatttgtttaaatgtttaatgttggtactgagtgctgtggcataggaatagggaactttttcttagggtcggtgatggattcttgggaaaataaaatgaagggcaaatggaagcaaaagacaatttaatttgcttctgttttaagggaacttttaaaaagttaattcttaaattttttaatttaaggacttcgtcaagaaacatcgaattaaatatattgagtttaaccctaacaagcatcagatctttcagtctgctgtatgaggaaatacaagtttctttctgctttctattatgattgttgatttgcatgagcgtgttttaggttaggctgtgttatgctgtggtaatacataccaccaacatcctcatgatttaacacaataaaaaacttctgctcacaccaagtctgcttgagggctcattggctccgtggaaactgatctccatgtccaggccagtttggtcttgtggccgtccgttttagggcagtgcttagggtcaggagagcaaaacacagggctggagagttaagcacaggcaactaaatgcttcagcatgggaatggcattcattttcactcacaggatgtgttcagcttagtcacatggctgtctatgcctaacctcaagggaagggagtgcagtcctccaggaactcagatgtaaaaaagccagtatgatggatatagtattgtctacaaaaaaaagtagcataatagagttagatacaagcaaagtactctaggatcccagtaaggagaagtaagaaattctgatgagatgcagggagagccttagaagggttcatgaagatggtgacagatgatacaaactcagtagaatgagcaggtttttcttagatttgaagagaagaaaggacattcaaactaagggaacaacactgactgagtcagagctagactcaaagctagagtctactggctgatgtcgtgggagaggaagaagagatgagcgggccttgaattcgtttaacattcagcaaaaatgtattgcatgtctaccatgtgttaggcactgtttcaggtttggggaatatctgataatgaacaaaacacaaaaagcctgtccttgtgaaggttacatgctagtggaagaagcgctaaggagttagtattttattataagcacactggtgagtaagcaaagataggaacattggatgcctgtgaatcttaagattttcctggccgagcgcggtggctcatgcctgtaatcccagcactttgggaggctgaggtgggtagatcacttaaggtcaggagttcgagactagcctggccaacatagtgaaaccctgtctctactaaaaatacaaaaattagccgggtatggtggcgcgcacctgagtcccagctactcatgaggctgaggcaggagaattgcttcaacctgggaggcggaggttgcagtgagctgagattgcgccactgcactccagctgacagagtgagactccatctcaaaaaaaaaaaggatttttctaagatttctattttacattaaatagaaggcagttggtttgcatgaaaattattatttcatcaatttgactgcctcattatagaaaacacatattgaagtcaaataaaacgtagagatgaatctctgaagttaaaatatgttatttgggacgcaagaattgcaatttggggcacacagaccacagggtggtcttcagtatgtatgaagaacaaagtaaaggatggaggttttataaagagaagtgttacatattttgaaagacaggtcattggcactagtaaagttttggggaggtggcaagccctgattggtgagtgacagtggtgggtaatactggtcttagagtcagcaacaagttgtttcagtagccattagataaactggtttcaggttacaataggcagtttcagcagccaggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtagcagttttgtaccaactgctgttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaatatggaaatcagaatcatttttgttagaggaacaatgtttacaagttgcctagatttgcagtgaggtcataaaaagcctgtttaatctaaaatagacatttgcaataaaaacagaaattgttgttgagatgccatattatgtgataactgagtaaaacagacaagagcctatcccctaacctggtatgtgaatgtgaaaatattagagaaataatgaagaagtagatggagactaatgaggaaattctgaaaaggacatcttttgagaaattcagaggtagatggcgcaagttttaaagcttactttcactttaaaacacctgagtttcatttcctttgatttgagtaaattacaaagcagtttattagttaaatcaggcttgttttgatttataggtatatagagaaagacaggacattttcctggacagaaagttggaaaagagaaacgtgtaaagggggtggaaagtggctgtgagtgcatgtggaatgagaagcctcccttgggcaggagttaacagccacaatggggaaaggattgggacatctaatcctttgagtgtgtgtgggggccaagggagcagtagtagcaggatgcctgcgcatacagccatgtacacagtgtgtacacagaagtgtaattcttgggcctgaatatttcatagggtagagacatattgagtactttattaagtaagcatattgagtactttattcatctatacaacaagggtcgtctattaagggccacacagtctagctgtttctgtaaagcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctctgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacaccacgctaatttttttttttttttgtatttttgtatttttgtagagacggggtttcaccatgttggtcaggctggtctcgaactcctgacctcgtgatccacctgccttggcctcccaaagtgctgggattacaggcatgagccaccgtgcccaacctattttattttcaagacagggccttgccctgtcacccgagctggagtgcagtggctcaatcatggctcactatagcctcaacctcctggggtcaggcagttctcccacctcagcctctcgagtagctgagactacaggcatgcactgccacacccggctaatgtttaaaaaatttttttgtagagacagggttctcaccgtgttgcccaggctggtcttgaactcctgtgttcaagcagtcctcctgcctcaacctcccagagtgttgggattacaggcatgagccaccatgcctcactaattaagctttttcttttttggggggttaggggggtgtcgggggttgggacggagtcttgccctgtagcccaggcctggagtgaagtggcatggtctcggctctctgcaacctccgcctcccaggttcaagcgtttctcttgcctcagcctcctgagtagctgagattacaggcgcacaccaccacgcctggctaattattttttttttttttgtatttttagtagaggtggggtttcaccatgttagtcaggctggtttcaaactcctgacctcaggtgatctgcccgcctcagcctcccaaagtgctgggattataggcatgagccaccacgcccagcctaattaagctttctcaaaagaacatgaaacatatattaggtgtctgggagttttttgttttgtttttgtttttgttttttttctgaggcagagtctcactctgtcacccaggctggagtgcagtggtgcaatctcggctcactgcaagctccgccttctgggttcaagccattctcctgcctcagcctcctgagtagctgggattataggcatgagccaccacgcccagcctaattaagctttctcaaaagaacatgaaacatatattaggtgtttgggagttttttgttttgtttttgtttttgttttttttatgaggcagagtctcactctgtcacccaggctggagtgcagtggtgcaatctcggctcactgcaagctccgccttctgggttcacgccattctcctgcctcagcctcccgagtagctgggactacaggcatccaccactgcacccggctaattttttgtatttttagtagagacggggtttcactgtgttagccaggatggtctcgatctcatctcgtgatccgcctgcctcagcctcccacagtgctgggattacaggcgtgagccaccacgcctggcccatctgggagttcttttgctttcccattactttaaacgttggaaatatcatagagtgtttaaatagtctttacctttaaaaataggtaatgttttgttctttttcagtagcaaatgtctgctaccacagtaaaaattgtctttaacttcaggtatacacttatgtgtatgagctcatgttacttgctaatcaatattattgtcaatatttacagatttatcttcaagaagtttcttaatctctctacttttctcatagcgtatgtttaatcggttattgtgtaggaaggcacatactttcctaacctttgtgaaatggctttctgctcagccccgttcctattaatcaaaaatacatgcattaaaaccacaaaactaactccctcctcttgttatactcatatggtacagagcctgttttgcctctttttttttttttttttttttttttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccggctaatttttgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcatttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctgtctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtttcaccatgttggccaggctggtctcgaactcctgatgtcaggtgatccacccacctcagcctcccagagtgctgggattacaggcgtgagccaccatgcctggcctgaatgtagtaatacttttgaaggaagcttttaaaacaaatgctctccctgtgcgagacccttctgatagatgtgccaagactgtgacacatatggcgtagcattcatgcctgcagcccaccaggcctggggctgcaagagcatgagccctgggtctgtcatctgtcagcatgcatcctctgtttgcagcaatgtgccctgtaaatattttcatttcctgtgtgtgcggagacttggaaaaggttgggaagcactggactgtgctaactggaattttaaaagactgttgccagaaatttgccttttgacaattcattaattttagtgataaaattcttgtggatttttagttaagactccttgttgctgagctgccttatagactgcttttggaatctgtaaacagcttgtgtgggcggagctgtccttgttgtccttgattaaagctttcttgagataaggaacggtgagacctctgagtttcttagttcccaccagttccaggtggctacttgccagcttcctcatgtgggcagagatggtgggccaagagagcgttgagacagacgaacctcttccatttaccttacctgatttacattatctagagtctggcctgtggtgtttacttctagtaggttctttctctagaaatgcttgaatatgactagcagagtggtttaatttaaaaactttctcagtttctcagtttttttaaaactttgaacaagttctcactcgtaagtggagttgaacaatgagaacacatggacacagggaggggaacatcacacaccagggcctgtcggggtgaggggcaaggggagggatagcattaggagaaacacctaatgtagctgatgggtcgatgggcgcagcaaaccaccatggcacatgtatacctgtttaacctgcacgttctgcacatgtatcccagaacttaaagtaaaaaaaaaaaaaaaaaaaaaaaaaaaaaaggaaaaactttgaacaaaatcattttactcttgtggggttttttttgcctattgtagatatgacatataaaatgtaaacattatagaaatatagaaattcattatgtagaaagtaagttccttgaaatttgtctcttcaaagacaatcactttcagcagtttggtgtatattcccagagttttttatatagacattaacttttaaaaaattttaacagaaagggactcatggaacatgatgacagtttttttacttagtaatgtaccttgaccatgtctgggtcttagtactcatagatctgacatattagtctaaaggcagcatagtcttcctggctatggtggtaccatagtttatttcctatcagtgggcattagggttgtttctaaatttttgttgttacaaacagatctgcagtggacattctttagcattgcgtgtccttgttaagtgtttctgtaggataattcctagaaatggaagtcctgggtgaaagtggatgactatttgacattgtaatagatactactaaattggttttgaataaaaagtgatgtacctactttattattctaccaaaatggaatagagtgttcattttcgtacatgcttctacactgtagataatttttgtctatctgaaggtctcaatctgtttttgctgctgtaacacaataccagggactaggtaatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagagaaaaccagaagttgctttttcccttttcactacttagatttatgatctttttatatatttttgtcattcataatttctttttgaggcaagttccctggccacccgcagtagctcatgcctgtattcatagtgctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttctttttttttaatcttagtgatttaaaccctttatgtttcagtcatctgtctgatgtgtctgttaatgtaggttatgaatatctttccctagattactccttttaactgtttatgatgtctttcttgttttagggaagtttttaagtatttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacgaggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccgggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattcatgtggtatgtatttgggaagattagtattaggtgtagggatctgactttttttttccacttggattacaattgtcccagaaccatcagttctctcccaacaattgaagatacctgcgttaacacataataaattctcatatgtgtcctgttatttctccagtctgtttatttagtcctatacccatactgtggtgtttttattactgcagctgtggattgtatgttttaggtcaagttcccctcctgatgattcttttttttttctctctctctttttttggtgagatggagtctcgctctgtcgctaggctggagtgcagtggcgggatctcggctaactgcaacctccacctcccgggtttaagcaattcgcctgcctcagcctcctgagtaagtgggattacaggtgtgtgccaccacgcccagctaatttttgtatttttagtagagaggggatttcatcatgttggccaggatggtctcgatctcttgaacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatgggattagttggttttttgttttttgttttttttactagtagcagtagaatcttttcaaatatgccttaatataggcgctggggcttgcccgtggtgctcttgatatataaggcccggacattctgccagttttttctcgagcagtgacaccaagaagttaacagccaggtgaatgttatgcacaagctcatcgtctgtcatcttcacgtggccaacagccacagccaaacataacatgttcatatgaaacttgattgtggacttcgcctcatccactttggccaccgtgttttcatcgtgtgtgagcagggaagggaactttactgcctttgttaggcctatgccgaggattcgtgggatttgctttatcagagactctgaagccaaaaatgcatcatacttcttggccagcttcttgaccagattcttattcttgagtttttttggcacctcagtgtccacttggggggatatccgtggccttggtctcgtcacagtgctgctgttcccccaggacccacacttgggacagggagtggacttaagcctgacggtgcccgagaagcgcttgtccttctgggggtcatagttcttcaagctgatctgcaactccaccatcttcaggaacttggggcactttcactggttcccgtgcaggacttcctgcaccgcctcatccagggtgtcgtgagagactttgctgcttatgggttctcatgccacgctaaccagaaaagagggtttagttggttttataaattattaatagtttgggaggaaattgatattttaatgatgccaagtctttctttcttttttttctttcttttttttttttgagacggaatttcgctcttgttgcccaggctagagtgcagtggcgtgatctcagctcaccacaacctccgcctcctgggttcaagcaattctcccacctcagcctcccgagtagctgggattacaggcatgcaccaccatgcccggctaatttttgtatttttagtagagacgggtttctccatgttggtcagactggtctcaaactcccaacctcaggtgatccacccgcctcggcctcccaaagtgctgggattaccagtgtaagccaccacatccggctaatgccaaatgtttctattcaggaatgtgcatgtgtctcaaatttgttttcaggttttgtaacttttttcatctatgttttatataatgcttgttaaattcatttcaagctattttataatttttgttgctaatgtaaatggaacttttttttcctcaagaaggcaataatcatataacttcttgcatttgggaaacttttgatctctcatttggaatgtcgaaaattaagtttatattgttttttaatagcatgctttttttttttttttgagacagagtctggctctgtcgcccaggctggagtgcagcgcgatctcggctcactgcaagctccaccttttggactcaagcaacctcccacttcagcctccccagtagctgggaccacaagcacacagtaccgcacctggcttattttattttattttattttatttatttattttattttattttatttttggtagagatggagtttcaccatattgcccaggctggtcttgaactcctgagcttaagcagtccgcctgcctcggcctcccaaagtgctgagattacaggcgtgagccaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctgtacaggtttttctgtgaacataagttttaatttctctaggagtgacattactggatcgtgtggtaaagaattaagtgaattgttaactagaaaactgattttatataacagtataatattcctagtagaaagaaacctaaagcctctggtctggtctgtgaattggtgtatttttattacttagtacttttcttttctttctttttttttttttttaaagatggacttttgctcttgttgcccaggctggagtgcaatggctcaatctcagctcaccgcaacctccacctcccaggttcaagcgattcccctgcctcagcctccctagtagctgggattacaggcatgtgccaccatgcccagctaattttgtatttttagtaaagacagagtttctccatgttggtcaggctggtcttgaactcccgacctcagatgatccgcccgccttggcctccccaggtgctgggattacaggcatgagccaccacacccagctacttagtacttttctcagctaagatctttatttttgtcagcgttctcttgccctgtgatgggaacgtgatgtatcttgcctattgaagaactaaaacctctgaagaaaacccagagggttgtgggaagagtggcattgatgatttggggacttaatttgttctgagtcagtataagttaaaggcttattgtgtattatgttgagagttttaactgctatccttggggtaagaacagagatgtagaattatatcgtgaaaagaattttctgaaagaagggagtagggacaatctatatcatgcatttaagtcacaaggatgtcgtgaacataaaagatactcacgaaggccgggcatggtggctcatgcctgtaattccagcactttaggaggccaaggtgggcagatcacaaggtcaagagatcgagacctgaggtcaggagtttgggaccagcctggccaacatggcaaaatcccatctctactaaaaatacaaaaaatagccggggatggtggtgtgcgcctgtagtcccagctactcgggaggctgaggcaggagaatcacttgaacccgggaggcggaggttgcagtgagccaagatcatgccagtacactccagcctggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagttcagtttagatgagacttcccacaggatgaccatgaaccaatcagaaatggatatcaaaatgctcattttatatatttttaaaatacatgtaccagttgtgaaattcatctgatttagctcttaaatgaaaatgctacccattatccatattgtcctggaagcatctatcccatatttactatgaatctggggatgttagttgcatctgctgtcttgcttttgaccaacttttcatagcttatggttattttggtgtgaaatattgcctgttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggccccaacttttttaagctctttcttctgttactccaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttctagcttatctttcaaatattttgcagtactcacacatataatataatgtattagctcaagagagaatcggtgagtataaattagagacagcaaggtagctctttctaggcacagataagtgggatggtagctacagggagacattaggccaaggtattttttagaagatggacaaaatatcaacatatttctctactaatggggataatctcataaaaaggaggaaattggtgctgtcgaagagattttggaataggtgaggggatggtggaggcattggtctttggataacatggacagttcttccatagaaataggaggaaagcaagccaggcgtggtggatcacgcctgtaatccctgcacttcgggaggccgaagcgagtggatcacctgatatcaggagttcgagaccagcctggccaacatggtgaaacctcatctctactaaaaatacaaaaaattatctgggcatggtggcgtgcccctgtaatcccagctactcaggaagctgaggcaggcgaattgcttgaacccaggaggcagaggttgtggtgagccgagatcgcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtaatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgaaaggacaaaggagcattgttatacaacaccccaggagcattgttatacaacaacatcacaatgaaattagtgatataattaggaactaagaacttgaggaggaagactgaccctatgaaggtgtggggtcagtgaattacagatcctggtaagttccaacagttattagagtactagattgagtgagcaggaaggtagaagaagttagttaaagaatgggaagctcaaacttggatcatgaaaggttttcagatattgggaatgtcaaagactggagtataaccatgtaagtagcttaagtatgtaatattttttttctttctggaagtttatccttggtttttagaaattagccattgaggtgccaagggttagtcttcattcattgttcttggtgctcattggacccttttaatatagaggtttttgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcacttgaggtcaggagtttgagaccagcctggtcaacatggtgaaaccctgcctctactaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagccctggtattatgaatgttgtttcttctgctgactccctgagaatagtaaaggctttttttttttttttttttttttagctcttttataaagtagatttttgttccctgcattgcttctctttttttctggggttctttcttgttaccgctctttcatatagagactttctctggatgtctggtagcctctggttgtctgtacctaatgtggagccctaagcatctgatcacaagctgtgtttgtatgaataggacatgtttgaccacagagctttcctattgggagttgtctggtgcttttattgaagaccccagatatttgtgtccttagatttctgagagtatccagtttctctagataagaatcttctcttctgcctgggaggaactgatgatcccacccctcagtcacttagtcctcccccgcctgccttttcatctgttgcttcactcctgaaaccacgtttcttcatcctggggtgtgtgaaacttcctgagactttgcataaatgcttatgtttagtcacgagtttgttggtgaagactatgttaacaactttacagaaagtttggagaatagagaagaaaaaccccacaatcctaatattctgaataccatttttgtttttgtatattttccatatacatgttttttcaacatatttttgattataattttgtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggctgggcgcggtggctcacgcctgtaatcccagcactttgggaggctgaggcgggcggatcacgaggtcaggagatcgagaccatcctggctaacatggtgaaaccccgtctctactaaaaatacgaaaacaaaattagctgggcgtggtggcgggcgcctgtagtcccagctaccaggaggctgaggtgggagaatggcgtgaacccgggaggtggagcttgcagtgagccgagattgtaccactgtactccagcctgggtgacagagcgagaccccgtctcataaataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttaagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctaccaggttgtctgaggggaggggtgaactggcccagaaacggagcaggtcaaaattcctctgctgatcagtgggatggggattgggatcaagattgcttctgtgaatagccactgcctggggaacatagcgagatcctgtctcttaagaaaaagaaacagaaacttttggaaacaagcagacaagggtgaaagaaagccttggtgtaagatataatttatatattccatataagatatagaatacatatgttatataactaaaaagcataaaaacagtcagcatgcttttagtacaacctggaggtatggttaatgtgcaggaaaaaagctccatataagcctaatccctatatataaaaaatcacggaattccacagttttgaacatttttttttctttttgagacagagtcttgctctgtcgcccagcctggagtgcagtggtgcaatcttggctcactgcagctctctacctcctgggcccaagcagtccttccacctcagcctcctgagtagctgggaccagaggtgtgtactaccacatccggctgattttttgtattttctacagagacaaagcatccccatgttgctcaggctggtctcgaactcctgggctaaagtgatccttctgcctgggcctcccaaagtgctgggattaaagggatgagccaccacacctggccaacactttttttgtgtgtgtggtaaaatacatacaacataaaagttataattttaaccattttttaagtgtgtagttcagtgacatcaactatatgtacattattgggcaaccatcaccactattcatttccaggcagatagttaatactcatttttttgtggtttctatatttgcaaatttacctgttcgaaaaaatttatttgtaacacccaaatcagtacagcgctttggtaatccttttcggacatatgcagaacggtgaaaaaatatgcacatccctagttgaggttcaacaaggggacactttgctttctttttttcagtctttgtgccgtaaaccagtgtcttttttgtgatctatttaatgccttttttttcatttttgtactttttgttgatgattttgccatttaaaatgggccccaagcatagtgctgaagtgctgtctagtcttcctaacgcacccttgagtgaaacttacctaacacctgcattttctttgtaaggcacatcatagccttgccatggataaaactctggacagttgagtttttccttgcactgcacatggctatggtgctttacaaagaagatgcacgtgttagaagtttcactcaagtgtgcgttacagtgctgtggctgtgaattcagtgttaaccaatcatatatagtaaagaaggtgttcttaaacagacacacacataaaacaaacttatgtattaatctgctgttgcaaaatgttgtgaccagaggcttgcagaaacctaacccccagaagcaatgatttcgtattcactaattcagtgagcacagtaactgcatagaatgaacaatgagaattgactgtagctccttttttgaaagaagaggcttaattatggagcaaggcatcaggaaaaatcacaggctttcctcatttgtgtgatttttttattttgttcatgtcttcaagagtggagccctaagaagaaagctgagagctcccagtaaaggggtgacgagtgcctggcttagcctcatagaggccagaggaacgtcggtctttacactgggacattccacacacgcaacacagagttattttctatggacagttgagtttttccttttccaagcatattctagggttgtctttctgtgccctgctacatgttccactgtactgctgtcagatttttatctcccagaaattctttgaagtcacttgtcttctggtggcagcccttcccttctcttggccattctttgtcatttggtctttgttcttcagtgggcctatcaggtggcaggacagagaaatgcatgtgatcaatatgccatctttaaccaatgtcctcattatggttatgaaaataacttttcatgtaattatttttattcaagttacatattacacacagtttaaagagtcaagacttgttaaaaaagagtcccctagactcactggtttccttgtctcccaggatggccacttttaatcttttaaagtgattctttagtcttttaaatgattctttcatactttataacatgcttgtagtcttacttgtttttcaggtttaggcattatctattgacattttatttaaagtcatcattgactttaaaaacacaaaaactctttactgaaatgtaacacaggttgggtgcaatggctcatgcctgtgaatcccagcactttgggaagccgaggcaggcagatcacctgaagtcaggggttcaagaccagcctgaccaatatggtgaaaccctgtctctactaaaaatacaaaaattagctgggcatggtgtgtgtgcctgtagtcccagctacttgagaggctgagacaggagaattgcttgaacccaggaggtggaggttgcagtgagccaagatcgcgcgactgcactccagcctgggcgatagagcaagactccatttcaaaaacaaaacaaaaagaaacgtaacatacataaaaagtgcccaaatcataagtgtacagcttgatgaattatcacaaagtaaacacatttgaataaccatgacccgggcaaaaaatatactgtgacccacaccctagaagcctccctttggcctccttcaaatcccttcactaccccacctcctcaagtgaaccactgtgccaccttctaataccataggttttgtctgtttgttgttttaacattgtactaatagaatgttagagtattttaataatagtgtattattttgtgtctatttcttttactctacttcatgcttgtgatattcttccatgttgaggttttcatttgtaaccaactgttgtagttgtttgacttggcctccatttgctatggattgaatcgtatgcctcaaaattcatatgtgtaagccctaacccccagtgtgactgtatttggtgatagggtctttatagaaggttaagtgaagtcgtagtatgaatcctgattgatagggttagtgttattacatgaagagacaccagaacgctagctttttctaccacatgagaacgcagggagagggtggccatctgcaagccaggaagaaggtcccctccagaactgtgagaaaataaattactgttaagtcccccagtgtgtggtattttggttatggcagtccaagatgactaatgcatcattcttcaggccactctatccccctagaggacttgcagtcttttttttttttttgcctcctcttttactgactgagaatgttgttaacactttcagaaacagggtgttaggatcttttgaccgttggtgaaccaacagaaagtggaagataaggatttttctccagtgggtgtttgctgtggatttgttgggagaagcccatctcatgtatgagctgtcccatccctattttgtaatattccactttgctgctggcatcagagtgaatgtaaatggaatttcccagaaatttccacagcaagtggctttctcacttagtgagcccccttggtgtttgttgagtctccctttacccaaccccacaatcactggaataaaggggtggtcttctctccagtctacacctttctgaggcactgcaatcggggataccccagttaccacctcttttggtgaccccaaggtttcagctttgcctgagctctccaggctccagctctgggccaaggtgattttggtggagtcatcccagcggggagctaggaggaagaggggattaggaactcccgctcaggcttccttgctgcacgtacacatgtcacatcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaatacaaaaattagctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccagcctgggtaacataaggagacctcatttctacaaaaaattagctggacatggtggcacgtgcctatagttccatctactcgggaggctgaggtgggatgatcacctgaacctgcggaagtcgaggctgcaatgaactgtgatcatgtcactgcactccaccctggacaacagaatgagacctcgtctcaaaaaaaaaaaacaaaaaaaagaatctttagaataggaggaggatattgagcagaaccataagaaactagtgattaagagtccaggtgtgaaaatagaaaccacgtctcagaagctcagagagaagaagaactggaaaggcagcatctttgatggatttggccatgaagaggaggaggaataaagcagaatggaggccagaaaagagtgtgtatgtctaacggtttcattggaattgggagatctaggtataccatgtaaaattacttatgaaggtaaagtttgaagaaaattcattcgactttgatttatataatttttaaaacctcattatctgttaaaacaccagaagccctgttttttggttactgattatgagtgttcaaggcctcagatcaactcagcatttatttatttatttatttttatttttttgagagggagtctcgctgtcttgccaggctggagtgcagtggcatgatctcggctcactgcaacctctacctcccaaattcaagcaattctcctgccttagcctcccgagtagctgggattacaggcccatgccaccatgcccagctaattttttgtatttttagtagagatggggtttcaccatgttggccaggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttccaggtttcaagtggttctcccgcctcagcctttcaagtagctggtgggattataggcatccgccaccaagctcagctaatttttgtatttttagtagagacggggtttcaccatgttggccaggctggtctcgaactcctgacctcaggtgatccacccacctcccaaagtgctgggattacaggcatgagccacctcacccggacaactcagtatttattgagtactccttatgtgccagttagggctataaagatgaataagatgtcttttccccagttgagatatgcataagacagttcgtgtttgcctgtttcagtagtcagtattttcttttgcttattcagtttccactgaaacttatgttttccaaatacaaaattagaattccaactttgcgtttttcaggcgcacacactcgttttccctccactccttccccagttctgatttgcttcctcctgaaaatgggggttatagcccatccactccagggtcagaattgctggataccttgttgcagtgattttttctgtagctcctctggaggttatagactcatagggaataaataatgtggtcaggtggaggctttagaccaagttaagcagggtttttaaaacatggtgttaatgtacataatgcagccattctcaaaagtatgacatggggagacccctggaggttttctgagacccttttaaggagtctgccgagtcaaaactatttttgtgatactagtaaaacatttgcttttttcattctgtctctcacaagtgtagagtggaattttccagaggttacatgatgtgtgatatcacaacagattgaatgtagaagcttgtatgaaaatttcatacaaatatattatttgtgttataatgtgcttattgttattttgaaatcaattgttaaatacttttttttttttttttttttacagtttctcagtttttatttgtattttggtagatattcgttgatacaacccacatttgggggaatgagtaatctttaaaagtgtaaaagggaccaaaaagtgtgagaatgtttgatgtagagaaactccaagctcattccctggactttggctatagatgctttcttcaggggtgggtcttctgggcctgtgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaaaaatttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttataacaatacgtttattagtttgaagccccaattttcttttttttttttcttttaagtgaaaacaagtttataaaagaagtaaagaaacaggccaggcgctgtggctcacacgtgtaatcctagcacattgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttgggagatggaggttgcaatgagccgagatcatgtcactgctctccagcctaggcaacagagggagactgtttcaaaaaaaaaaaaaaaagaaacaaaagaatggctgctccatagacagagcagcagtatcagctgcttgactgagtctacttatagttatttcttgattatatgctaaacaaggggtgaattattcatgagctttctgggaaaagggcagagatttcctggaactgaaggtccctccccttttaggggactatttagggtaacttcccaaggttgccgtggcatttgtaaactgtcatggtggtggtgggagtgtcttttagcatgctgatgcattataattagcttataatgagcagtgaggacaaccagaggtcactttcatcgccatcttggttttggtgggttttggcctgcttctttaccacatcctgttctatcagcagggtctttgtgacctgtatcttctgccaagctcctcctatctcaccctgtgactaagaatgcctgacttcctgggaatgcagcccagtaggtctcaggcttattttacccagccccttttcaagatggagttgctctggttcaaacacttctgacatatttcccccctcccttttacagggggacccttaatccttaagaattgtagcgggacaaagatcatctgtaacttcttcaagccaaataggggtgatgatattcctgcctattagggtctcttgtatttagggtagggagaagtttagttagaaagcattgttatagaagcccttattttcagttacacaattttataaagttacaattgcttattgtaaccagctgagttttaggttttgtggtttgttgcttgcttgcttgcttgcttcttaatgccatatatcttggcatttatcagtccataattactaaattcttaaaatccataaatatttattattctttctaggttgcaataaaaataattgacaaaactcagttgaatccaacaagtctacaaaaggtaagattggttcaatgtctagtactttttaaaaaattatcggtgctaattgccatctaatttgtcccttaaataccccaactgttattttatgtttaatgccataaagcttcctattcctcaaatgaatgcaacttaatgtagtatttcatgaaaaattgttgggttatctttggtcggagattatttttaaatgttcttaacagcacaaactaaaggctgtgctttttttttgtacttttttattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaagtctttgccctagtgccttttagaatcacctgggcagatttttgaaagtcttaacacttacataataatgcctaagcaattaggttgggcccaggcataggtatttcagtggtaggacatcagcaaataattaatgatcttcataataaaatccttctagttgtttttagcttcgcagagtctttttacatacttcatttgatttctagatttgacctgtagtagttgaggggggtacagagaccatgaagtaggaacaggaagtactgaatttcagtcctggctctgccacttagccgaatatctgaccttgagcaaggcacttaactttgctggaccttgggtttctcatctttaaaatggagataatttcatcttcttatgatggatgtgagtattaatgaaataatgcatataaaagggctttgtaaactgcacagcactgcacagttgtgcgatattttgataagagcagtgctctatatacatttctaatgtattcctcatggttatttatatcctggtaattttgaagccctgtccctgttttgtgtttgggaggtggggagggagatagactttctctgcactaaaaatgttatttcaacaagtggttctttgtgatctgcaacccataatgggccttaaggcttctcaaggtgggcatgaaacatctaaaaattccagtcctttgtcctgaagagtaaattttatctatttccttaaacttccatatcttcagctatctaaggatttggtactaataaatacattagagtttaatacaatgtggtattcagaactaaaattaacatacaaggatgtttaatgaggactctaattgagtattctatgatgttacataccttccactattcatgtgtacctggatataattgtaatcctaacagttttcccggaaaaatttttaccatggtgttgtatcaagttggctgcagtttttccttcttgtttgcttgcttcctttagtcattttttattttattttatttttttggtaatgatttttcattgctgctcttcgtttattatttgtcacatcattatcagtttagtgcatggtagtttggttagcccattagtgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcaattttgcaacaatgtagaatgtaccaggcaactttgtcagccccctttgcagtcattcttgcatccttttttcttctcagcaccattcatagttgtatcacacttgcttcaggaacagctctcttagatagtgatttaaagctgtggagcatgccctagcagctaacattcatcataaggaacattctgccatcagcagtgtgcaatctcttttttaccaccactaccgaaaaaggtggactggctcattcaggcagtattttaacagtgaacacacgtgttaaaatatcggtttcatgatattcaggcttgcatactgggtcatgaacatttactaaatgcacatataagtaaacctgagttgactatgtttgcaaattgatattattttcacagatgagtctcttcatttttcctttgtatttttgcagccattgaattaataaacgttagattctggtgagagatttatttttctccattgttttttaagagatgggtcttgctctgttgtccaggctggactcgaactcctgggcttaagcagtccttccactttagcctcccaagtagctgggactacaaatgcacaccacagcatctggctatataccttccaatgtctcactagtatatctggaatactattctattcttacgcatcttttaggtcaattttttgtttgttcgtttgtttttgtttttgtttttttgagatggagtctcgctctgttgcccaggctggagtgcagtagtgggatctgagttcactgcagtctccctctgcctcttgggttcaagcaattcttctccctcagcctcccaagtggctaggactacaggtgtacgccaccacacctggctaatgtttgtatttttagtacagatgggggatttgccatgttagccaggctggtctggtctcaaactcctgacctcaggtgatccacctgcctcagcctccacttgctgggattacacgtgtgagccaccatgcccaggccaaggtgtgtggatcacttgaggtcaggagttcgagaccagcctggtcaacatggtgaaaccgcgtctctactaaaaatacaaaaattagctgggcgtggtggcacatgcttataatcccagcttctcaggaggctgaggcaggagaattgcttgaacccaggaggcgacagaacaagactttgtctcaaaaaaaaacaagaaatttgtaacatgtaatgaaataattgattttttgtaatgtatttatgatagctggttagttagccaaccttgagcacattcagggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgttgattttctcttatgcagagtaaatcccctcagcctccttgggtactcccacaggagtttcgctgaacagaagcctactttattccatacttggaattgtttcccccctcccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctgacccagtagtaaagcattttttgagtaagatttaaccaccattcttaaatctagactgagtaggacagaaagggaaatccctgtgtttttaaattttaatgagatttacagaggaagaaaaaaaggaacattaaacacaaatatatgcaaaatacccagtaggatttattaaagcattattgactatggatttcatcagggtctttgtggggaaatcctgcttatacccacctcaatcttcctccctcccttccttccactggccttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgggcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttcttttcttttttttttgagacagagtcttgccctgtgacccaggctggagtgcagtggtgtgattttggctcactgcaacctctgcctcccgggttcaagagatacttctgcctcagccccctgagtagctgggactacaggtgtgtgccaccacgcctggctaatttttgtatttttagtagagacagggtttcaccatgttggtcagactggtctcccaactcctggcctcaggtgatctgcctgcctcagcctcccaaagtgctgggattactggcctgagccaccgtgctcagccaggacagtttaaatcttcaatcaggggctggacgcagtggcacacgccaataatggcagtactttgggaggccgaggcgggtggatcacctgaggccaggggttcgagaccagcctagccagcatggtgaaactgcatctctactaaaaatacaaaaattagttgggcgtggtgacataccccagctacccagtaggctgaggcacaagaatcgcttgaacctcggaggcggaggttgcagtgagccgagatcacaccactgcactccagcctgggtgacggtgagactctgcctcaaaaaataaataaataataaactgtcctgtttgggaaattagctgttatctccttttcttctgatttctaggaaggtcagataacaacttaatttaggtttgggaatgtggaatcttagcagggattactccatttttaattttaacctggtttcctggggcctaatgcaggagtttagtcccaaacaatggcttcctataatttttatttaacaattcttcccttttggtcaggctttcacctaggtaagagtgtaaccaaaacctaggatatccctgctgttctcagttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactaccattatgactatcatgaggatcacaccaagcatttagagtatgctcctaagccagggtttttatgaaccaaatcaactaaaattgtatagccaaacaaggagtctgccaattttaaccaagttgtccgctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcattgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactagaagaattcagaatctagttcagtcaggaataatcttatcaggtcatttctggaagtcaattctgtgaattaatattttagcagcgttttttgcttctaatttcaaattggaaggtatagggttattcattgtgcccctcaagcctggtccactccgatacccctcaagcaccagacacctacccaggaagagggaggctgttttctttttaaagctagtatttgctttggagccactgttagtgcttagagctctgtagcagtagcagtagtggccttttttggcgtcctagggaatcttggtcatgggatgtagcagggaaacttataatttgaaagcaaggagaaccagttcatgcttttcatgtggtctgtcgtgtaatgacttttactgctgccaccactgggttattttgggcactgttgatttagttttcttaagccagtacttttcaacccttcttgtgcattagaaacatttgtggagtttgaaaaaagcatatttccttcacagtactttcctccctagaggtcctatcttggcgggtctagaaatgtggtgatctcagtacacaccccagatgagaatggctcctagtctgtcttcacttcccccaaagttcttaatttctctcttcttccaattttacttatttttatttatttatttatttttttgagacggagtctcgctctgtcacccaggctggagtgcagtggtgcgatctcagctcactgcaagctctgcctcctgggttcacgccattctcctgcctcagcctcccgagtagctgggactacaagcacccgccaccacgcccggctaattttttgtatttttagtagagatggggtttcaccgtgttagccaggatggtctcaatctcctgacctcatgatctgcccgccttggcctcccaaagtgctgggattacaggcgtgagccaccacgcccggcctatttattttttattgattgagtgattgattgatggggtcttgtcctgttgcccaggatggaaggtagcagcaagaccagagctcactgcagcctggaattcctgggctcaagtatctttccacctcagcctcctgaggtagctgggactataggcgcgcaccaccacacccaactaaagtaacctattttatttatttatgagacggagtctccctctgttggccagcctggagtgcagtggtgccatctcggctcactgcaacccctgcctcccgagttcaagtgattctcctgcctcagcctcccaagtagctgggattacaggcacccgctgccacacccagctaatttttgtatttttagtagagacagggtttcaccgtgttagccaggctggtctcgaactcctgacctcaagtgatccacccgcttcagcctcccaaagtgctgaattacaggtgtggccaccgtgcccggcaaagtaacctattttaaagatgaccccttccccaaatattctaagtttcatagacagctgctactgccactgccactgctgaatattttctccctctctggaactcttcctaggaatgccttagtacccagttcctggcctcctttctctattgggtgaagcacaagttattttggaaatccttttcattgaacaactcttttcatctttttcttttctttcttttttttttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcaatcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccccgtctctactaaaaatacaaaaaaattagccaggtgtggtggcgcatgcctgtaatcccagctacttgggaggctaaggcaggagaatcacttgaacccaggagacggaggttgcagtgagccaagatggcaccactgcactccagcctgggcaacaaatgagaaactctgccaaaaaaaaaaaaaattgagaataaaactgtatatatgtttgtttatttttagatttcaaaagagaagaaatagaaaaaccggctttcagtattgttgcttctttattccttataaacttttaaatttcttgccagacttatttttgttttggcaataaataatacgggttgatatttagaatacattataaactcgggaagctgaggcaggaaaatggtgtgaacctgggaggcggagcttgcagtgagccgagatcacgccactgcactccatcctgggcgacagagtgagactccgtctcaaaaaaaaaaaatacattataaactgagaatagtagagtgtattttagagattgattgtttgtttttagaattgaggtctcactatcttgcccaagctggtctcagactcctgggttcaagcatcctccttccgaggattccaatctgccttccaaggagctgggattacaggcacacaccaccatacccagctaaagtatatttttcattgtaccaaggacttattatgctattttagaaaagtcaccaaggaaccaagtattttaagtgggttaaacttagagcatagcctggacccatttgcagaaaatataaacttgggtgcaaattaggcctttgtgagagaattataacagtaacatcagccagaatcacaaacacatgtcaggagtttattgtgtgccaggtgctgttccatgcactctgtatgtcaagccatcctttcattgtagaggtgacagggtcagggaggtcaagttacctagacttagtgagtggtacagctgggttgggattaggtagtatagctcctggaatcaaattctacacacactttatcttatagcattgcatgtacttttcacaacagtcctgtgaagcagttgttttctttttttttctttgagacagagttttgctcttgttgcccaggctggagtgcaatggcgtgatctcggctaaccgcaacctccacctccctggttcaagtgattcccctccctcagcctcccgagtagctgggattacaggcacccgccaccacgcccagctaatttttttgtatttttagtagagacagggtttctccatgttggtcaggctggtctggaactcccgacctcaggtgatccacctgcctcagcttcccaaagtgctgggattacaggcgtgagccaccacgccaggccgaagtagctgttttcaaaatctatcttataggtaagtaggttaaagctctcaagattttgtggtttgttcactcatccagtgaataagggactgaactagccttagaacctaaatttataacatcaaatagctttctttgcataagttcccttggagccagtcactcatagtactttccatatgggaaggataacaaaggaacatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcacctgtagtcctagctacttagggggctgaggctggaggattgcttgagcccgggaggtcgaggctgcagtgaaccatgttcatgccactgcattccagcttgggtgacagagcaagactccttctctaattaaaaaaaaaaaaaagcacacacattgttgctactcttattttacatttttagaaaactgatttgttgtattactcagctaaagctaagcaattttttaaaatttagtttttaatttttattaaatactgactgcatacaaaagaatgttccatgtttagcatataaatatgtatatgagatgagcacccttatactacctgcttcaagaaatagatcttcaaccatacctttaaaccagtcccatattgtgcccctcctcaacctgattccccttcttcattgcccacctactgggtaaacactaacaaggattttgtgttattattttcttgctttgtccgtgtaattttaccacatatggatcactcatcaatgtagtgtaaaggttttttttggtctgttttttgtttcttttgtgtttgtttgtttgtttgtgactgagtctcgcactgtctcccaggctggagtgcagtagtgcgatctcagctcactgtaacctctgcctcccaagttcaagcgattcttgtgcctcagcctcctgagtagcagggattacaggcgtgcgccaccacacccagctaatttttgtatttttagtagagaccaggtttcaccatgttggccaggccggtcttgaactcctgacctcaagtgatccacccacctcagcctcccaaagtgctggaattacaggcgtgagccaccgcaccccaccaatgtagtgtaaagtttaaaaaattgtataaatggactcatgctatgtgtattctcctattggcttttgctttgcttccttttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttttgctttcttttacctacattgtgttccatgttgatgtattttgctgtaattcaccttcactgctatgtccattttcaagaatatgtagtatcccattatgtgaatatgccactctgtatttattctgtgattcagagacatttggattgctttttgtattgcaaacatgactgctgtgaattgtcctctgtgtgtcctggcacacttgtgaagagtttcttaaatatatatacttagaattcttgtatcacagagtctgtctgcacatcctccttcttcattagagaaggccaaattattttcagagcaggtatgctaatttatatttccatcagtagtgtgtaagagagcacaagtaatgtagcatcctcatcaaaatttgattttctctgattttttaaaatttgtgccatcacaggagaattgcttgaacccgggaggtggaggttgcagtgagctgagattgcgccactgcactccagcctggcgacagagcaagactgcatctcaaaaaaacaaaaaaattgtgctatcaatttggtaaatataaaagtgatatttggccaggcatagtggcttcctccttaaattccagcactttgggagcctgagatgggaagatctctccaagccaggagttcaagaaccagcctgggcaacagagcaagactctgtatctacaaaaagattttttttttttttaattatctgggcatggtggcacatagctgtggtctcagataattgggaggctgaggattgattaagcccaggagtttacagctgcggtgagctgtgattgcaccactgcactccagccagggtaacagagcaggagcccctcttaaaaaaaaaaaaagaaaagaaaagaaaaatctcattatggttttaatgtaacattttcctaattactgatgaggtcatgcattttttcatatttaggttttttgtttcttctgtgaagtacgtattcatcttttgtttaatttctagtggattttttcttagttattttaggatatcattatatatcatggatactattatatatgtggcacacaccttctacttgatggtatatcttcactctcttgatactgtctctcagtgaatagcagaggctcctaattttaaagcagttacatttatcagtctttttttaatatgctttgcactttttatgtcttttttgtttttttgtttttttgtttttgagacggagtttcgctctgtcacccaggctggggtgcagtggcacgatctcggctcactgcaagcttcgcctcccgggttcacgccattctcctgcctcagcctcccgagtagctgggactacaggtgcctgccatcacgcctggctaattttttttgtatttttagtagagacggggtttcaccgtgttatccaggatggtctcgatctcctgacctcgtgatccacccatcttggcttcccaaagtgctggaattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacacacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgcggtggctcacacctgtaatcccagcactttgggaggctgaggtgggcggatcatgaggtcaggagattgagaccatcctggtgaacatggtgaagccccgtctctactaaaaaatacaaaaaaattagctgggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaataacagcacttccattagcccatagtatagctgttttaatccccttttcaggatacataacagctgtgtgctaggatattatcgtcataactattccaatgtgtgatgactatgaggtatattattttctcagagttgggcaatacataacatttgaataagccagactaacatctttctaggctatagttctaatgtagagcaataaaaatagaaccaaacaaaatatacaaacatgtggaacctaaaacacacagaattcttggatcaaagaaaaattgcaaacaaaaattacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaagggaacaaaataaatctcaggaataaataataatgtaaggagtcagtaaagctaaaggcagaaaataatgaatttgaaaacagtagaaatggtaaatccaaaactttggtgggtgtccccccccctcccaccgacaaggaagtgagaagagaggcaatgaaatagataagctactaagtgctgccagggggaagggagagaaaacacagaaaaatgagggggaaataccagatactgaagaatttaaattattataaaggaaccttttctgcaactctgaaaaatgttagaatatccaaagaaattgataattttctaggaaaacatgacttaccaaaattaactctagaaaagaatcgatacacatcagtaacaacagaagttgagaaagtagttaacatattgccaaacctggaattcatgattgaattctttgagatctactgtgagtacatactctgcctctgttcagctgttccagaacttaagaagaggaacttccaaattcttttctcaaattcagaaacaatgctattgaaatatattggaaacaggaacgaaaactacagttcagtttcacttataatatccattctaaaattgggaattaaaaatactagcatataggactaaatactggtacatttatctttgtttccccaaagattcactaaatgatggtaacggaattaaaaaggaggggaaaagagtccaggaattgagtactgaggcattctcaggaagagcaccaagagagggaggagatacccagcggtcacagtggaagtcgtctttgagacttagagcgtttgaggaaggggtcgtctttaaaataggttacctacctagcacttgggagaccagaccagcctgtggcaaccagtgacatcagttcctttgagtctttccagagatactctgtatattaagaagcaaatttttttttccttttttacacaaatgcattttcttgaaaattccttctcatgaactttgccagcctctctgtcttggtttgtctgagagggcctttgatgcactcttccatttaggtgctgtggtagttgaggcaaagggacagtttctgtagagtgatgagggagtgacttaggtggcctggtcttctgtcccttatctgtgtatctggagaagggagcctgaacaccttcattgtgatggtttagatcagttttatgtctgtaacccccgtgttctcttttacatactcattttactttcgtatcggttggtaaaattgtctttttttttttttttttttactagagactaaaattctctctctcttttttttctacttgtcaaaaggtaaaattttatttttccagtggtaatacttgacaacccccaggtcttggctattgggacatgtttctttacttctctgataccgtagatttagtgtccttgatatccccattgccaggattccaaatctttgccttcaaaggtatttattctcctcttgtgtgccagttccatagaggatgtatagatgtgaaaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcgggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaactttaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtgaagcatctggctctatgcgtcagacacagcaggcactagataactgttagcttcctgcttcctccctgtcctgcttgtttaacttagcataaagcttatttacacatttgctgcctgccagtatctacctaatacataattccaatagagaggtgaatacataaagttatttgggctaatatcctgccactacctctcttgggattctttggctgctctttttgcctacggaattaaatttttactagtcttctatctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgacaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggagacctacttagatacgttttcagagaatctgcctgagacttaaaggatgaaaagggagaagacatttaaaggaatttagtatgttctgtggccaggcgcggtggctcacatctgtaatcccagcactttggaggccaaggcagacaaatcacctgaggtcaggtgttcgagaccagcctggccaacgtggcaaaaccccgtctctgctaaaaatacaaaaattagccaggcatggtgggacctacaatcctagctgctctggaggctgagacagaagaatcccttgaacctgggaggcggaggttgcagtgagccgatattgtgccactgcattccagcctgggcatcagagtaagactccgtctcaaaaataaataaataaacaaacagtatgttctagtaactaaaaggagttggggtgactagaacgtacctttgaggggtatgcagaagttggcaggttgcagggatgccatggccatggtcagggtttcattctcagtgctgtgtatcctgagctatattgatatggcatccaaagtggagattgttgtctttttttttttttttttttttttttgagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccgctgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaacctgctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctgcgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgggcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttataaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaaaaacttttgatcccatatgcattgtaatagggcttttaaaaaattacataactgcttttttgtatagtgatagatcatacaatctaaaaataatatttcaagaatgaaatcactcttaagacagcccataatcagcttaactgtcaacatcagttttaggaaatgaaaggattgatgtttagtatcaaggatagcctatcaagaatgcatcaggcacaagaatagaagagtaacacagaaccaccacaggaagaaagaagcttttacagagagctgcttttttaacaaaaggcgtatgccctatttcatcagtctaaaccaccattactttaaaggtgttcttgtttccttgtttcatatactactaagagaaatgctagcaagccttcatcctgatatcagggatattaattaaaatgtgaaaaaaaaatttagaatcaataagtatggttgaagaaaaaaccacggaacaacttcatagttggattaaaaaaaaatcacaaggaatataatagtgggaagaaaatcttgtttccttgattttcatttcaatcctttggggctagctagccaactctggatttcaaattccaacttttcacacccgtcctcccgccccccacaaaaaaactttatcactgttgcctagaacaagctaacgtaaacatgtttattttgtcttttaattacttaaattgtgacctgattagagttttgtacttaaaacttgacatatctttgataataaattgaacttttaaaaaattcctattgcattaacatagttttcccagaagacccaaagtttcgttggaagattagaagagttttattttcatgcagcttaccaacacatgtgccttaactttctgaagtggcttttcttcacagtctgaacgtatcagagtctagggaatggtatgatagctttattcatcagttcatcaaacatttactgactgctatgttaggcattttgtttggcctgatactctattaaagcctcagaaaattgcttgaaatataaaacactagcataccccccagttttgggtaaacttaaagtaaatattaacataataaagtagatatgcacaatggtgatttgatagcttcagggatttactccagtttcatttttaaagtgtgtgtgtgtgtgtgtgtgtgtgtgtgtgtgtgtgtgtgtattctttttttttttttttttttttttttttgagacagggtctagctctgttgtccaggctggagtgcagtggcatgatctcaggtcactgcaacctccaccacactggctcaggccattctcccacctcagcctcccgagtagctgggactacaggtgcatgccgccatacccagctaatttttggcatttttttgtagagagggaattttgccatgttgccgagggtggtgtccaactcctcagcagaaacgatccacccgcctcagcctcccaaagtgctgggattacaggtgtgagccaccatactcagccaaaaatgtatatatttctaataaggttttatgaattagcagtgatagaaatatttccatctgtaacaaaagactgctgtaggaaaatcaccctgacctactgaaaatgattcttataaaaaagattccccccctcaattaattgcagtataatccctctacttctttccatctttggcatcagaaaagtaacaaaggaaccttgttctttgaaagttgtcataagtttcccaagcaataaaggtctcaaatagaattacatccttaaagccataatcataagcagctagatttgcatttgttggagcagagtagaactgagcagttgctgcaggctgaccacttttcctggggtgctgggagggcagctagccaacacagacatgctgaaggacagtgagggtgacagaggaagtgagctcaggtacaccttgctggactgctgagcacatatggaagtcacactgaacattcagaaattatttttatggaattccatgctttcatagactcttttctgttgttgtggtatttgataaaattccctaaaagcattttttagagggccagctattaaaatctttaacagggaaaaggttgcttttcatagttagagtttatatgtgcatggtttgtgcatacagacatttgtctctttttcttccgtgtcctctcctctcccgcagtgaagttattcgaagtcattgaaactgaaaaaacactctacctaatcatggaatatgcaagtggaggtaagaacatttttatatatattgggttttttttctttctcccttttaaaaaaatacacaaccatactgcccatatgggtcatcattaaggtctcatttaacgtccagagccataatacgctaggatgagagtcggaaaagctgactcttagcacttctaggggttgccatgaagtgtttcactattagcattgttaattggtaatatctaaatacctggatattttttgtggtaaaacatgcatcactgaaaattatcgttaaaatcatttttaggcgcacagttcagtgacattagcatgttcacgttgccctcaccaccacccatgtccagaatgttttcattttctaacacgaaactctatacccattaaacactaactctccatttctccttctcccagtccttggcaaccattctcctttctgtctctatgaatttgactactcttggaacctcatacaagtggaattttacaggatttgtcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctactacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggatttgtctttttgtgtctggctgattgatgcagcatagtgtcctcaaggttcatccatgctgtagcatgtgtcagaatttcattcctttttaaggccgaataatactccattgtgtgtgtgggacacacacctcacattttgtttatcttgagtatgtggctatttaaacatatgaatgcttagtctgtttgaaacaaatgtgtgctttggtttagatgcttttctttaccagattttaatgtcgctggtgtctgtcttccccaaggccagaaatgatggttacagtacacatcactagagtttccttaaaataaagattaatgactagtaactatttgcctatggttttgtaaaaatgtagacattttctgaaatgcgtgtttatagctgctgtcttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttcaggaccaaaaagctttatggagttctaatactttctgtgggcaaacaacacagagtaatgttcatagccctcacgttgtacagcctctacagtgtacaaggtgctttctcttaccagatctcctttgaccttcacagcgactccatgctgtggccaggcagtgagcgatgggctttttacccatgaggaaatggaggctgggaagtctcactgtgggcgctctgggcctggaccgccagtgctctgacagcagatagcctttctagtttgttggtcagtcacggctttctgttcccatctgttttagctacccaggtcacagagattactcatataggggcaagacaaaaacatctaagagtcatccaggtttagtagaaagaggatgggctctggaagagacagacatggagtgaatccagccagtggccctcattggccatgtgacctggcaagtaacatgtgctgagctgagcttcacggtgagcataggaaccccctctgagggctcagtgcacttggcaacattgtaagagcctttaatcatttaatcgaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccgggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagccacctgttcctgcccaggcaggagagccactctttgcttcttgtttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttgtattgaattcaaatttagaaaaaaaaatctgtcaattatattgacagacttggattttatctgtgttactctacaacagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaattagccgggtgtggtgacgcacgcctgtaatcccagctactcaggaggctgaggcacgagaattgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaaatattttagtttaatattttcactaagctgatggaggtattccttatttgtatgaagtaaagatgtttcctgaaaacacttatatctaattttctaaattagtattcttttctattgatttcagaggtggtgattctttattctacattgataagcagttgacagtgctaataatatattccttgaagtgtcacctttcttccctaaataattaatgttgtgtaaactgccacctaggcgtgcatcagctggttctgttgttttcacctccattgtatcctgagctcctacttctcaccaccactgtgcttcccactctagtccccgtcactttcatgattggtttgattattgtactgatctccctcttggtcttcctgtcccttcccgtcattggaagcctcttccccgctagcagccagtgatccttttaagaggtcagtcttttttcatctctgcttctcatctcacttgtagtagagccagagtcctcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcaatttatgggaaaattaatactcagaagtaggatttctacttacttttatttctctcacctataggtgaagtatttgactatttggttgcacatggcaggatgaaggaaaaagaagcaagatctaaatttagacaggtatgaattaatgtgtctttactatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtaggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttaactctcttgttgtagcttagaagcagtcgtaggctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagagactccatctcaaaaaaaaaaaaaaaaaaaaagaagcagcagctgtagacaataccaaatgaatgaacgtgactgtgttccaacaaaactttatttacaaaaacagggatgggccggatgtagccagaggccataatttgccaacccctgatttagacgaaggaaaggagcagtgcttcactgcttttaaattaattctgtattctcacaaggcctacattgaaatggaattatagcctcattttttcttagaacctttatattttgttttattcatatacagggttgtcaagctggacagactattaaagttcaagtctcctttgatttgcttagtctgatgtttacatttgtaagtgataggacttattaagtttcttataaacgttgcttatattttgctgttgcttaaatactaatggtactttgaattcaaatctagtaaaaccaaagtaaaaatcagctttggctatcatttaacttctctgatcctgtttttaaagctataaaaaaaaaagaaattattcttgatgaattccatagttctttgcaattctaatataatttgattgtatggtctattaaaggaaattcagatttttattagaaaaaaagtgtgtggctctttccataactgtactcttaatttttataaattggccacctaaaagggaacatttttttgcttcatacaatttacattccttcctactcagatgaatctgacttgcaaacatgtgtgaagatggcttattgactatgaggaaggggctggtgtcacccagcaagagcttactaacctaaatcttgaggaaattactctaatttttattgtaaattccctgcagaaattctgaagcctttatttgaggagcctgttagttggactaggaaagatggtttgtatgtatgtgttttttcaattagcaaattgatttagagtgctttagaattgaccctttcttccatggtatttgcctaaaacagctccattagacttggaaggatacgcatcatattggtgtttccacttttctgtttcaaatgctgtggtttctttgttttttcgtttttgagatggagtctccctctgtcaccaaggctggagtgcagtggcccgatctcagctcactgcaacctccgcctcccaggttcaagcaattctcctgcctcagcctcccaagtagctgggattacaagtgtgcaccaccacgcccagctaattttttatttttttttttgtaattttagtagagacaaggtttcaccagtgttggccaggctggtctcagactcctgatctcaagtgatctgccctcctcagcctcccaaaatgctgggattacagatgtgagccatcgtaatgtggcctcaatttctgtgctttctaggagcttataagtcataattactttgactaagtaaaacaagtttttctatttatgacaaaaaggaaggtatgccacacacaaagtacactgtgtgtgatcccttttccatattcatcaccagatgggttttccccttctgcttccttcaccatgcccatcctagttactgcttatgacattttaattttttggttgagctcattcttttccaagaaaaagaatagatttccagctccatctttttttttttttttttttttttttttttttgagacaaatctcgctttgtcgcccaggctggagtgcagtggcgcgatctcggctcactgcaagctccgccccctgggttcacgccattcttctgcctcagcctcccaagtagctgggaatacagatgcctgccactacgcccggctaattttttgtatatttagtagagacaggatttcactgtgttagtcaggatggtctcgatctcctgacctcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggttagctttgagctgttttggagctaaagagagagagaaatcctttgatctctttgagaaagggcaggaaatcaaatctgcttcaaaagcagaatttgaaaataacctgtaagagaaatctcaatatgaggaaaaactaatataaattctgaatgagaaaaggaaaaagattagataaaatttacctgtgtcctaggtgacaaagctatgactttgttttgggaaaacaaagctattttacttttcaagttttcatgctgactgaatagaacaatagtgataaatccaaagtaacagatgctctaaaacccgttttttggcattggaatttttgtaccttttgttaattataagtgggtctgatattctgaatgttaattttaaataatgaagctgcttagtaaagtgctgatttttgttatcatctcatcctaaccccagttcaccttgtccttgctgcttattctgaaccaaaatattatacagccctctgagattttatgtccacgggtgggtccatggggcttagagctaagagttgatgatgatttggaggaaccaacagtaattttattataacctcagttttgtgtatatgtaatcatatgtgtctaaatatacatgcagaataccaaagaaaagactagatgcaagtacagcaaaatagcaagacatgttacctctgcttagtggtaatgcaggaatatatttctatagacttttctgtatttcctgaaatttctacaatgaccatataaagctttaatattagaagactttttttaagtgaccgtaagtgtgaaatttcagtaaaacaattgtttaatcataggcatgactgcaagttgactaaataaaagcatactatttactgaaagtgggaggaatccttaatagtgcacgtagtagttttcatagttcacgtacgtcgcaacattcattcctccattttaataaaggaagaggaaactgaccctcagagaagttaactaacttttgctttccatgatccacatcagttagaaggaagactgttgcagggagcaggctgagaagggcacttacagaagagagccaacctggattaacacctgggtatgggcaactctctaaccgctggtttggtttggagttgactctatgggtatggaaaggttgcaccaggccgggcgcagtggctcacacctgtaatcctagcactttgggaggctgagactggcggatcacctgaggtcaggagttcgagaccagcctggccaacgtggtgaaaccccatctctactaaaaatacgaaattggccgggcatggtggtgcacacttgtaatcccagctactcgggagactgaggcaggagaactgcttgaacctgggacggggaggttgcagtgagccaagatcatgccattgcactctagcctgggtgacagaacgagactctgttaaaaaaaaaaaaaaaaaaaagttgcaccagagccatcggagcctaggggcagccagggtcctccagatctaggcaatttgttgggtcctggcactacactgtaagtggaatgtcaacggatagggtccaaaaagagacttcagttaaaacagtagaaaacggaagaacgtcctcacctatttgtttttgccctcacccatgaatttctccagactggaaagttcaaggcataggaaaattgtttttagaaatccacacggacattcgagcgtatactgagtattcattatgtgtgaacattaacaaagttattttcatcttaattacgaatctgcaccagtgatgactgactctgcgtctctcctattcagattgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatcacacagccaaacaaatgtgggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggggtgcttctgctctgagctctgggtcctgattccctctgggggctgtgctctgtctgatgcctcttttctctccgtttgtttattcactctccttctctactggcttttcaccagcagcatttacacatgctcaagtctatatacctttttttttttttaactaaaaagccatgcctgttcctctttcagatacacgctttttctctcttccctttcatagccatatttctctaaacatttcctagattctgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtaccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttcacttcatctgggaagccattcacacctttcagtgccaacccacaactccctgtgcctcttcagttatggcattttgtctcaggacagctgcttatcattctccttcttcccttctaaactgtgagctactgagggtagggctttatctgtcttgttcatcattatccatccagacactaatatagcatctgctgtggagtagccacataggaaatgtttcttaaagtgactgtgatttgtctctttttttttttttttttttttttttttgagacggagtctcactttgttgccctggctagagtgcagtggtgcgatctctgctcactgcaacctccacctcgcaggttcaagcgattctcctgcctcagcctctcaagtagctgggattacaggcgcccaccaccatgcccagctaattttttgtatttttagtagagatggggcttcaccatgttggccagactggtctcgaactcctgacctcaggtgatccacccgcctcagcctcccaaagtgctgtgattacaggcgtgagccaccgcacccagccatgatttgactcttgaatgaggtttaggattctcccctcctcattaacagccgttttatagctatttagccgtttttatgaaatgcccctttttaaaaaaagttatttatgttttgagacagggttttactctgtcacccaggctggagtgcagtggcacagtcatagctcactgcagcctcaaactcccaggcttaagaggtcctcctacctcagccttccaagtagctgggattgcagatgtgtgccaccatacccagctaatttttaaaaatcttttgtagagaaagggtctcactatgttgcccaagctggtcttgaactcctgggctcaagtgagccactgtacctggccctgccccatattattcttgttttttggttttgagatggagtattgctctgtcgcccaggctggagtgcagtggcacgatcttggctcactgcaacctctgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattatcaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtcatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcacgccactgcactccagcctgggtgacagagcgagactctgtctcaaaaaaaaaaaaaaaaaaaaaaagatggatgttgtcataaacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatggtaagttttggagtatcccagtgccttctcttagagtccaggcaagaggtctcctagcactgggaagcattctcttgctcagagcctggcttgatgtcctttcttggcattgctttctttctttcttcttttttttttttttttttttttttttttgagacagagtctcactctgttgcccaggctggagtggagtggcacaattttggctcactgcaacctccacctcccaggttcaagcgattctcctgcctcagcctcctgaatagctgggactacaggtgtgtaccaccatgcctggctaagttttgtatttttagtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagcgttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttattatttttatttatttatttatttatttatttttcagatggaatctggctctgtcgcccaggctggaatgcagtggcatgatcttggctcactgcaacctccacctcccaggtcccagcagttctcctgcctcagcctcctgagtagctgggattacaggcatgcacaaccacacccggctaatttttgtatttttaatagagacagggtttcaccatattggctaggctggtcttgaacttgggagctcaagcaatccactcaccttggcctccaaaagtgatgggattacaggtgtgagccaccgcgcctggccttatttatttgtttattttttgagatggaattttgctcttgttacccaggctggagtgcaatggcatgatctccgctcactgcaacctcagcctccgaagtagctgggactataggcacacaccaccacacctggccaatattgtatttttagtagagacgggatttcaccatgttggccaggctggtctagaactcctgacctcaggtgatccacccaccttggcctcccaaagtgctggattacacgtgtgagtctgtaattggcctggctgatttttacccttttaaaattttcctggccggacatggtggctcatgcctgtaattccagcaccttgggaggccgaggcgtgtggatcactaggtcaggagttcgagactagcctgaccaacgtggtgaaaccccatctctactaaaaataaaaaaattacctgggcatggtggtgtgtgcctgtaattccagctactcaggaggctgaggtaggagaatcgcttgaacctgggaggcagaggttgcagtgagccaagatcgtgtgactgcactccagcctagtgacagagtgagagtccatctcaaaaaaaaaaaaaaaaatttgtacttaagtgtaatatatagccagttgtggccagtaactctcataatagacaggacagccctggagaatatatggaacctcagttttgccttaattggtttaaatgttgtactgtgtcattctcatccatactcttgctgttagtgtggttaagccactctcccttttaaacttcacctagaagccagtcctttatgagacataagactcccagtgggtaggcttaccaggctctacagttgctctgccttcaaggcagcctgtgtgtcagagtcctgaggctagcgtgtgtgtttacttgcccataactataaatgttaacattgcagatatttcctttaattctactattccaggattcaggaactaaatctatttttttttttttttttgagatggagtttcactcttgtcacccaggctggagtgcaatagcgcgatctcggctcactgcaacctccgcctcctgggttctagcaattctcctgcctcagcctcccgagtagctgggactacaggcatgcatcaccatgcccagctaatttttttatttttagtagagacggggtttcaccacatttggccaggctggtcccgaactcctgaactcaggtgatccatccacctcagcctcccaaagtgctcggattacaggcatgagtcactgcgctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggatttgtgctcctagcatttgtaggtgacgtgttgatctaggtctgccttttttgtgttcatgttagtcactaacaaggggggtttctagtgcttatggaccacatggcaattaaatgcccatatattgccctgaaaccatctggtttaacttgtccctcaatcctagaagaaacctgacaatgggattttcacatttctctaaggaatatgttagtaagttattccttaagcacatagattccatccagattattagtgcctttttccccccagctcaattttagagataaaaagagctttagacatggtattgtacactcaccaaacctctgttttatccctaaatagaccaagagagattaccaagtctcccaaggttacatagtaaatgagaaacacctggggcagagctcaggcctgctggtccaagccctgtgttttttctccactgaagcacctcattggagtagctttttcataatcctcatctttcttggaatttctgaaggcaggcaagcctgtatagccgggctaactttcacctcatcctcctgcctcgtctcacctctcccttcccttttccttgcctgtggatgctgacctctgcatgggtgcctgcttctctaaagctacgatgtaatctgtagctgtccttcctcgtttgagacccacatgtgaacaccccatatgtgtgcactttttctgcgaatggtgatcatctgattttcaaggggttagcttgttttttaaaaaatgaaaaaaaaaatcactgtttactaatcaatgagtggtattggggcaatttggtagttctcagaaaaaaaattaatttggatcaatttctcacatcttatacaaggatgaattctaattggagttaagatacaaatatagggctgggcgcagtggctcatgcctgtaatcccagcactttgggagtccgaggcaggtggatcacgaggtcaggagatcgagaccatcctggctaacatggtgaaaccctgtctctactaaaaaatagaaaaaattagccaggcgtggtggtgggcacctatagtcccagctactcaggaggctgaggcaggagaatggatgaacccgggaggcggagcttgcagtgagccgagatcgagccactgcactccagcctgggcgacagagcgagactccgtctcaaaaaaaaaaaaaaaaaagatgtaaataaaactccagaaatattgaaagaaaccttgggattatttgctttgtaacttggactggtgaaggtgtttctgtcaccccaaacaccaaacccatgaaataaaagacttacaaatttgattacataaaaatgaaatttctggccggtcgcataatcccagcactttgggaggccgaggtgggcggatcacgaggtcaggagatcgagaacatcctggctaacacggtgaaaccctgtgtctactaaaaatacaaaaacaaaatcagctgagcttggtgtcaagtgcctgtagtcctagctgctcaggaggctgaggcaggagaatggcgtgaacctgggaggtggagcttgcagtgagccaagatcatgccactgcactccagcctgggccaacagagcgaggctccatctcaaaaaaaaaaaaaaaaaaaatgaaatttctgtgtgacacatccataccatggactactactcacaataaaaaggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtggaggttgcagtgagccaagattgagccactgcactccacagcctggccacagagcgagactccgtctcgaaaaaaaaaaaaaggaacaaactatgatgtgcacaactcagatggatctcaagggaattatactgcatgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatacacaaacatacaaattagtgcaagtaaaactggggaaatctgaacgaggtcagtggattagatcaaggtctgtttctcttcagaatctcaaatcttaaaaggttttgtattttctaaacacaaataaaagctggaaagccaatcagtagtaatctgaaagttcacaatgtcagtagacgtctcatggtattgggaagaaagataagcattgaggctaatatcaccctatgcttgattaagtttttgttttatatgttaaaatcactaaaccgaaagcttagttgttgttctcccacaaataaaattaagccctcatttacttttaattcagttccaaataggtttgccatttagatttttgtccaagaactaactcctccccactcccggtttttgtttgtttgttttttaaatttatttattgagacaggttctcactctgtcacccaagccacatgtagcctcaaactcttgagctgaagccatcctcccacctcagtctcccaaagtgttggaattacaagcatgaactaccacacacctcccacctttaatatatctaaaatataaattctcttctgccttagaaaaaacaggctgggcgcagtagctcatgcctgtaatcacagcactttgggaggccaaggtgggtggatcacgaggtcaggagatcgagaccatcctggctaacactgtgaaaccccgtctctactaaaaaaaaaaaaatatatacaaaaaaaaaaaattagttggcatgcgcctgtagtttcagctactccggaggctgaggcgggagaatcccttgaacccagtaggcagtggttacagtgagccgcgattgcgccactgcactccagcctgggcgagagagctagactccgtctcgaaaaagaaaaaacaagcatttgactctgtcttttaagattaccactggattatcatatctgaggcatatactagttatcatgttcatttccaagattctttgccctctgaatctcctgtgctgctattggagtctctatatggtttactacaggacattagtctgtcatccacatgtccctaggcacatgtccctggacacactcctcctggagtggcaggaatgactagtgacctccaccgacttcctccctgtcgcttgcatgattcctctgcttctacaccttcccctgtctactcaaactccggtttatctagaagattatgagtgcttttaaaaagatccaagataaaacttcaaaagaagtggcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactattaaaaaaaaaatgttttaagtagaaaggagtattaagtgaaatttcaatattgaattcattgcataaggcaaacattagatataagtgggaaacatcttagaggattttactgttttacattttttaggtgaatagcaaccttagatcatcttacaaaatatggttactgtcacaaaataaaacttgaaactatattcagtcatttaaaaaatgaactctttattttagctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtgtaagtgttgttgaactatagagtggtcttagggtggtagggttggaaccagctagacaccaggtgttcattttactcctgtggtctctcgtactggaatgccctctctactaggcagccatgcccaatcttaacttacagaaatcctacctgctgcattgtaggtatttattgttgacactctcttagttcattcttgctgctgtaacaaaatacctgagactggctaatttataaagaaaagacatttatttcttaacaattctggaggctgagaagtccaagatgaaggcaccaacaagttccgtgtctggcaagggccctgttctctgcttccaacatgatgccttggtgctggcatcctccagaggagacaaatgctgtgttgtcatgtggctgaagggacagaaggggtgaactcaccccctcaagcccttctataaaacactaatctggccgggtgcggtggctcacgcctgtaatctcagcactttgggaggccgaggtgggtagatcacgaggtcaggagttcaagaccagcctggccaagatggtgaaacgccatctctactaaaaatacaaaaattagctgggcgtggtggcaggcacctgtaatcccagctgctcaggaggctgaggtagagaattgcttgaactcaggaggcagaggttacagtgagccgagatcgcatcactgcactctagcctggcgacagagcgagactccttctcaaaaaaaaaaaaaaagatactaatcccttcatgaaggcggagccctcgtggcctaaacacctaaaagactcatctccaaatactgttttctcctatgggagataaagcttaaacatgagttttggaggggacacattcagagcatagcacacccaccatagacactagatggtgataggtcctttatttcaaggcctggttccagttatttcggacacctgctgagccttaggttgtcaggtgctgagacatggaaagacctcacagtctaacaggaagtgaatgaaaacagtgacagtgcagatggaagcctacgtgcacacacggggaggtctgactgccagtgccccaaagatgtggtgttcacactgagtcttcaaagagctctaatgatgaagagtgttggctgagttcttaccatgtgccaaggaccatgctcagtgctttttcatggattagctacattttaaggtgaaaaaaaagttgggtaattgcctaaaattacactgccaacctgaatccagctcttaatccctatctgtaacaaaatctccccagtaagtagataatatttactaaattaaattgaatccattcagcttcagaaacttttttctgtgtattgaagtatgttctatctaacctaacatattaaagaatttgcagagaagtaaacaatcttaagattattctgtaagcacgtttttccctacaaaattaacaatgatgcagccctgcctccaactccagaaaaaccctggactgaggaggctgtggagaaaccctgttgctctctgaaagcccttcattgttccattctggggactgggtgcatgaaggaccccaaggggctttgcatgtttcatcctctgaccttatgcttagtcgaagtaaaccctgtgtgaaaagtttattttggcctccaaatgccatacagtaggattattgtttccatactcctgcagttaaaattccgtctccaacgtttgttgacagttaccagagaagatgagggcattattccctgccttcatgacttctcttcccctttgctcttgtctacacacgctgcccttctgaaagtgaatcatgagtattttcagtccacccatactaaattacttacaaaggaaaaaaggtagttagcaacattattattttctcccatgagtctttgggatttctctgtagatggtctgctcaagctgtagtaaaagtgactgctctatctttgtttaaaaattatctgataaaattccatagctatggccaggcacggtggctcacacccgtaatccctgcactgtgggaggccaaagtgggcggatcacttgaggtcaggagttcaagaacagcctggccaacatggtgaaatcccatctctactaaaaatacaaaaattagccgggtatagtggcgtgctcctgtaatcctagctattcgggaggctgaggcaggagaattgctttaaccgagaagatggaggttgcagtgagctgagattgtgtcattgcactccagcctgggtaacagagcgagactccatctcaaaaaataaaaaaaaaagtccatagctgtgacttgttccttgctttttagttttttgttttggaagttaaattcatgtgaatccacatgacaatgattaaccattttaaagtgggcaatgcggtggcatttggtacactcacagtattgtgcagccaacacctgtctttagtttcagaactttttcagctccccagaaggagcatctgtttaggctgggcacagtggctaacccctataatctcagcgctttgggaggctgaggtgggaggatcacttgagcccaagagtctgagatcagcctgggcaccagagtgagacctcatctctacaaaaaaaattaaaaagaaaatagctgagcgtgatgatgcacacctgtagtaccagctacttgagagcttgagaggctcaggtgggaagatcatttcagcccaagaggttgaggctgcagtgagtcatggtcacatcaccatattccagcctgggcaacagagcaagaccctgtccttaaaaaaaaaaaaagtggccgggcgcagtggctcacgcctgtaatcccagcactttgggaggctgaagtgggcagatcacaaggtcaggcgttcaagaccagcctggccatcatggtgaaaccccatctctactaaaaatacaaaaattagccaggcatggtggcgggcacctgtaatcccagctactcgggaggctaaggcaggagaatcgattgaacccaggacgcagaagttgcagtgagccgagatggtgccactgcactccagcctgggcgaaaaagcgaggctccatctcaaaaaaaaaaaaaaaaagaacacctgtatcccttaagtaatcactttccattcctcctctcccctctgcccccctcccttccccctcattccctggcaaccaccagtctgtgttctgtctctggatttgcctgttctgaatattttatataaatggaaccatttcacatgtatccttttgtgtctacttctttctttgactcagcataatgttttcatggttcatccaatttgtagcatgtattttcttttccctttttttttttttgagatggcatttcgctcctgttgcccagagtgcaatggcacgatcttggctcactgcaaactccacctcccgggttcaagcgattctcctgcctcagcctcctgagtagctgggattacaggcgtgcgccaccatgcctggataattttgtatttttagtagagacggggtttctccatgttggtcagtctggtctcgaactcccgacctcaggtgatccacccgcctcggcctcccaaagcgctgggattacaggcgtgagccactgtgcccagcctgcagcatgtattagtactttgtttcttttgggggtaatattccattctgtatatatactacaatttaactgttcatctgttgatggacatttatattatttccatgtattggttaaaatgaataatgctactataaacaattgtgtacaaatttctatgtggacttaaatgttttaatttctttccttctttcttggggaggagacggtctcactctgtcacctaggctaaagtacaatggtgcaaacacggctcattgcaacttcgacctcccagacccaagtgatcctcccacctcagcctcccaaatagctgataccacaggcatgcatcaccatgcctggcttattttttctgtttgtttgttgtggtagagatgaggtctccctatgtagcccagccaggctggtctcaaactcctaggctcaagcagacatcctgcctcagcctcccaaagtgctgggattataggtgttagcctctgcacctggctgtgttttcatttttcctgggtatatatttaggaataaaattgttgagtaatatggtaactccatgtttaattttttgagaaactgccaaactgttttcctcacaactgtaccattttatccagcaatagtgagagtccctgttttcttcacattctttctaacaattaataattattttattatttaaagctttcctagcaggtatgaagtagtacctcatgcttttgatttgcatttctttaatgaccaatgatattgggcatcttttcatgtgtttcttggccatacgtatagctttttttttttttttttttttgagactgagttttgctcttgttacacaggctggagtgcaatggtgcgatctcagctcaccgcaacctctacctcccaggtttaagtgattctcctacctcagcctcctggcctcctgagtagctgggattacaggcatgcaccaccacagccagctaattttgtatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatatctattgaaggtgccgattttaaaattaggttgtcaggccgggcacctcaggaggctgaggcaggagaatcgcttgaacccaggagggggaggttgcagtgagccgagatcgcaccgctgcattccagcatggcgacagagcaacactgcatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaagaccttgcctcaaaaaacaagtaaataaaagactgacattcctatttatgtagataagttcattttttctcattgtactgtatttaccaaataaatttaagacaaaaatgcccttttttatagagtaacacagcatctggtggaatgacacgacgaaatacttatgtttgcagtgagagaactacagctgatagacactcagtgattcagaatggcaaagaaaacaggtaggagattctacctgtttgtaagaaaagttgtttttcccaagagaaatggaagcatgttatttactgctttgttcttataatcattttcaaattaaaactgtaagtattctctgaaggtaagttaaatttgtatactaatttttagcaagatactagaattctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaaatagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcagaacaaatttcccaggctggcatggattttccttctttgtttttggaagagcagtaagtgtacatcattcttttaacttgaacattgtttgcatcagaattgttctgacatttactttctgcagttacggtgtgaggttctgtttcttaatcctaacctatgtttgatctcattagtcaaacaaaatgtttgatcactacattttgtgacagcctaatcaaaaattctctcctccttcatccttagttccaaactgcttatcacttccctgttccataggccacttaggattgagttgatatgaggagtaacatttgttctgtaagattatggttattattcgttgaatttttagcaatatttacattctcttgttctcttttatgactcgtgtgtgtgtgtgtgtgtgtttcaacattgtcttttcttatgattaaaaactactaagaacttgagtatagcagctggggtagatagtttacagataatgattgatataggtatttctttttttttttttttttttttttttttgagacagagtctcactctgtcacccaggctggagtgcagtggcctgatctcggctcactgcaagctccgcctcccgggttcacgccattctcctgcctcagcctcccgagtagctgggactacaggcgcctgccaccactcccaggtaattttttgtatttttagtagagacggggtttcaccatgttagccaggatggtctcgatctcctgaccttgtgatccacccacctcggcctcccaaagtgctgggattacaggcgtgagccaccgtacccagccaggtatttcttaatagtagtctactctctggtagatttgtattatagttcagttcttaactttcaaatttcttctagttcaaaagtgacttaatagaaaatatcaatagaagacttaattagaagtttctggtgttacagattgtagtctacaggactacagaaatgtttcatggtcaggcacagtggctcacacctgtaatcccagcactctgggaggccaaggcaggtggatcacttgaggtcaggagttcgtgaccagcctggccaacatggtgaaaccccgtctctactaaaaatacgaaaattaaccatgtgtggtggcacgcgcctgtagtcccagctaccagggagactgaggcaggagaattacttgaacccaggaggcagagtttgcagtgagctgagatcgcgccactgcagtccagcctggacaacagagcaagactcatctaaaaaaaaaaaaagttgtttcattacctttactacttctaaattctgaaaatgcactacccagctccttctgaactttaggatatgtgactgtctgaggtgcagagtcagtctcctcaagggtgttaagactaagatctgctctctgcttccatcctgtgctacacgtatcatacaccaggcacatgcatatatgcctgtgtcttctgattctcttttcctaaaatttttcgtttcactctttggaaataatatttaagacttctttaatttctttggcaatatttcctttctgcattccccctggagacacctgccttgttggggccaactctttcatatcctgacctgtctcgttgcttctcttagcatcagtcattgaaatactttgcttctgaaggtgtcgtctttctctttagtcaaagagagtctcaccgccaaaccttaaaagacagggcccattgttttaataatatttggactttcctttcctatcttataaatgaattaaaagactggaaaattattgggtttaacttctttagttaaggcactaaatgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgttcatacggaatttcaacatgagaataatgatggctgattttttaaaaactgtgtgaaggtttaaaccagagactccacatatcttaagcccttactaccttcaaaatcctactgtaaacaggatattttaaaggcttactaaatgcaaggctttttctcgtcataggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcatttaaagaccccagagaagtgacgtgctggtgttacagtaatgcaaacagaatcttttcttttttttttttctttttttctttttttttctgcgatggagtctcgctcttttacccaggctagagtgcaatggcacgatctcgggtcactgcaacctccatctcccgggttcatgcagttcttctgcctcagcctcccagtagctgggattacaggcacacaccaccacacctggctgatttttgtatttttaatagaaatggggtttcactaggccaggctggtctcaaattcctgacttcaagtgatccacctgccttggcctcccaaagtgctgtgattacaggcatgagccactgcaccaggcccagaatctttcaaataaattttagatattggatattactgtaaagtttcaaaattgtgaagtggcttattattttatccactttaccctgcatcaagtcacatagagattgagcagagaaggattgaggacacttagcgtatgtatctttggactacatataaaagttgctttttttaggctgggcgcggtggctcccacctgtaatcccagcattttaggaggctgaggcaggtggatcatgaggtcaggagatcaagaccatcctgaccaacatggtgaaaccctgtctaaaattaattagctgggcgtggtggcatgcgcctgtagtcccagctacttgggaagctgaggcaggagaatcacttgaacccaggaggcagaggttgcagtgagccgagatagcgccactgcactccagcctggcaacagagcaagactctgtctcaaaaacaaaaaaaaagggctgagcacagtggcttacgcctgtaatcccagcactttgcgaagctgaggtgggcggatcacctgaggtcaggagtttgagaccagcctgaccaacatggagaaaccccatctctactaaaaatacaaaaaaaaaaaaaaaaattagccaggcatggtggcgcatgcctataatcccagctacttgggaggccgaggcaggagaatcgcttgaacccaggaggcagaggttgcggtgagccaagattgcaccattgcactccagcctgggcaacaagagcaaaaccccatctcaaagaaaaaaaaaaaaggctgcttttttttttttttttttttttttaagatggatggagtcttgcagtgtggcccaggctgcagtacagtggctagtcacagacatgatcatagtgtactgtagccttgaactcctgggctcaaatgatcctcctgtgttggcttcttgagtagctgggactacaggcatggaccaccacacctggctaattttttattttttgtagagatgaagtcttcccatgttacccaggctggtctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaagatcacttgaggccaagagttcaaggtcagcctggacaaagtagcctgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtgcatcacctggggtcgggagttcaagaccagcctggccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttatgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgttgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagtgatgggtttttgccatgttggccaggctggtctggaactcctggcctcaagcaatccacccgcctcagcctcccaaagtgctgggattacaggcgtgggccaccacgcccagcctcaagttaataatttataatcccagcactttgggaggccaagacgggcggattgcctaagctcaggagttccagaccagcctgggccatgacgaaaccctatctctacaaaatttttttttttaatttataatgagaaaataaatttacatttccttcttaggtctctagaggatccattttttttctgcaaagcatctgtccacaccctcttaccatgcttgtatgccttaaagatctagcttggcctgtcagcagtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagagtgtgttgaccctggactcaccctgaaaggtaagggcacaagagatagttgtatttagctgtatcttgttagaaaaatacatttgtgtagccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcagagcttgcagtgagcagagatcacactgcactccagcctgggcgacagagtgagactccgtctcaaaaaaaaaaaaataaataacatttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcaggtggtctccttgatctgtgtggggcctagagttacttccaccacagcaaaatctcattattgttgctgcaggaaaagaatggatactgagtggcagaaatacgaaactggataaatttttgcctttataagacatttgtttccagtccttctcagactgtataaattctcccaagtcagagagcagaattctcaaacaaaaatgcagggacagaaccaggcacagtggctcacaaggcctataatcccagcactttgggaggctgaggcagaaggatcagttgaacccaggagttcaagaccagcctagccatcatagtgagacaccatctctacaaaaaatttaaaaattagccaggcatagtggcacactcctgtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgctttatgttggggctatcagaattccagttgctaattgattaatctgctctgttaggagaacgtttgttgaatacctgccctgccaggctttctgcttacactggtggggggcacattgacaagattttgggctgtgttttcagggacctccagcagagaagggtcactaggatacaatgtggcatgcatgagctaaaaacagaagtgatttaactctcagagggaaaatggatcagataacacttcatagagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttattaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaaagcaactataggttagcagttgctccagaatctccaaaacaagcttaggagatttttattctttaccagaaatgagatggcttgggaggaaggtgtgtgcattacacacaggttgctctgtggtcactgctccttcatactgtgtttctgcctctgcctgaacccaaacccctcccagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatgtaagaaaaatgcacattctttgtgaaactaatgtgtacccactgcttcttaattttgtgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggtaagtgctaggtgctggttgttttggagtgaacacatagagcaaaaggaaagatgtcttttttgttgtgtgaagccactgctacctggatgcttttcagtctgccttcagctcatggttttctggttttatatatatctaactttatactttaaaacctttaaagtagaaattgtagagctcagagtcttcataacactaaaagttaactagcatttaggaggtttttgttactgttctttaattattgttccttttgctcacgtatctgtctgcatggcatgttcgttgttgttgagcaggcagacctcgagttctggtgtggggtggggggctggcactctgtaacaatcagcaggaaagaccatgcatgtctttcataatcatctccagccccagaggaaagagacagcttctcttttctcactttattgttgttaaggagcagtaaatttcttaagagtccaaatcttgaaagtttctctctcagtcttagtaatttatattgagagcaaggtaatgtccttaaatggtatagttttggagataaaatctctggtttattatcaaaaaataatgttactattattaagttatttttattaaatgctgcatgattcttggctgatggtcctggaaattttttaaaatgttccatgtgtctagtaggctagcatctggggcctcagtaaactctcaagggtcctttgagattaacttcatttccgtaaccttgttacctgttacaaaagcccagaaatactggctgcttcaagaggaaaaagaaaggataccactttgaaccgtaaacaatagtgaaaggcacctttccgagaaggagcccaggaaacccaagagcccctgcagtttcaggacatccttggagaaatgttttgaaattaagcctagctgtggatgagtctgtctgtggtatcttgcaggtttgcctaggacggaccctcttatttgtcatctgtagcttacaggacagcagtaggagtctttcccgagtctgaaatgatcagtaccctcctctgtttttctgcattccctatggcctatagcctattacttcatttcactccatctccattatttaaactaagctaaatgtaatcttgtattcgatcatctgaaacttcggtgagtcacattaaagtctgatctacttattattaggacatggaatagattagggagtattccttttttttttttttttaattttttttttttttttgagacggagtctcactgtcgccaaggctggagtgcagtggtgcaatcttggctaacttcaacctccgcctagattagggaggatctctgacatccattagcattaactagaagtcagacgcatcagaaggtttctatttaccctcttactcacttcttagcccctttattaagccacctcattttaaactgggcaaaacagaatcagccaaagagctttgccaggtttgggacacccattcatgaccagccagcaagagagacagtgagttcaatctgagaagagtctggtgactcccagaataaaccattccttcctggccagccgtggtggttcatgcttgtaatcccagcactttgggaggccaaggcgggtggatctcctgaagtcaggagtttgagaccagcctgaccaatatggtgaaaccccatctctactaaaaatacaaaaattagccaggcatggtggtgggcgcctggagtcccagctacccaggaggctgagacaggagaattgcttgaacccggaaggcagaggttgcagtgagccgagatcgtaccactgcactctagtctgggtgacaaagtgagactgtgtctcaaaaaaaaaaaaaaaaaaactttgagtttatttttcttctttgtactcttttttcagtcattttaagactagtattgggctgggccggatggctcatgcctgtaatctcagcactttgggaggccaagaggggcggatcacctggggtcaggagtttgagacaggcctggccaacatggcaaaaccccatctctactaaaaatacaaaaattagccaggggtggtggcgctcgcctgtagtcccagctactctggaggctgagccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcacgcctgtaatcccagcactttgggaggccgaggcaggtggatcacctgaggtcgggaatttgagaccatcctagccaacatggagaaacccagtctctactaaaaatacaaaattagccgggcatggtggcacatgcctgtaatcccagggagactgaggcaggagaatcacttgaacctgggaggcagaggttgtggtgagccgaggtcacgccattgcactccagcctgggcaacaacagtgaaactctgtctcaaaaaaaaaaaaaaaaaaaaagactagcattgattttattacatgtatataatggaaaaaaggaaacaagattatcattgataaaaatatcagctacctctttttttttccccacagagtctcactttatcgcccaggctggagtgcagtggcatgatctcagcccatggcaatcttcgccttccaggttcaagtgattcctgtgcttcagcctcccgagtggctgggactacaggcgcccaccatcgcgcctggctaatttttgtatttttagtagagacccggttttatcatgttggccaggctggtcttgaactgctgacctcaagtgatccaccgcgcccagccaaagctaccattatttgaatgcttattatgtgctaaggtagatgtctatatacatagatacagtcatattcattttatacatataaatatgtatgtacattatatatatgcatattttatgtataaaatgagtatcatatatatacacttatatgtgtgaaatgagtatatttatacacatgtacaagtgtgcacacacactcatttaatttaatctccatagtccaccccattttgtaaaagaaactgaaggtgaagtttggagagattaaggcacatattttaaaaagtatcagggcctggtgcagtggcttacgcctgtaatcccagcactttgggaggccaaggcaggtagatcaggtagatcactcaaggtcaggagttcaagaccagcctggccaacatggtgaaaccccatctctactaaaaatacaaaaattagcttgatgttgtggcacatgcttgtaattccagctatttggaagggtgaggcaagaggatggcttgaacccaggaggcgtaggttgcagagagccaagatcacaccattgcactccagcctggcgacagattgacactccatctcaaaaaaaaaaaaaagtatcaggctgagccaggtctatctgaccagactctgcccttttagccactacactgtgctccctttagaaaaaacagttgcaggcgtgacagttgcattacatttatttcatatatttgaattaaaattggagactcaggcttgttgtttaaaaaaattctaagtggtcatcttgtttacaatttccaggctatttccacacccccagatttttgcagaaagatagtcttttatcctgtcttgttaaagtttattaactgaggtctgttgtctcccttagtgctatacttaatcagctactgacagtttgttcttaaaaacaatcaaaatccttgctagagtggttgaaagttcttatcctcctttagcaataattggtaggattaaaattgcattgcctgaaaggctgaggtgtttgcacttagatgctgcaagggagacctggtgtggccaggtctggagagggctgcagtcaggaagcctgcactctgcttggagagcacatggctttggagagctatgggctatttgtagtcgggagcaaaactctctctccttaggatcaggcctggccttgctcagagactgcagagtcacccataccctgcaggcagaacagccaggcacacgcaagtgcctctgccctcaggttgatccatgttgccatgggcagtgtgaaggcctcctcctgcagctgcctccttcctctttatacctcaagggattataggaggaaaagttaagaaaagcacttctatagtaattgaccagtaaccctgatttttccggtggaagattaggaaatgtccaggcaccatggctcatgcctataatcccagcactttgggaggctgagccacatggatcacttgagcccaggagttcaagaccagcctggacaacataatgagaccccatctctactttttttttttttgagacggagtctcgctctgtcacccaggctggagtgcagtggcacgatcttggttcactgcagtgtctgcctcctgggttcaagcgattatcctgcctcagcctccccagtagctgggactacaggtgcatgtcaccacgcccagctaatttttgtatttttagtagagacagggtttcaccatgttggccaggctggtcacaaactcctgacctcaagtgatccgcccacctcagcctcccaaagtgctgggattacaggcatgagccaccacacccagccttttatttttttaataaaaagaaaaaaagttgggaaatgggccaggcactgtacatggctcatgccagtaatcctgacactttgggggaaggtgaggcaggaggatcatttgaagccaggagttcaaggctgacctgggcaacataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacgaaaatatatcttaaagacttttaatcattttcaactaaaatattttggataatactgccttatatttaggcagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttactacataaaagtaaaattcatactgttgtcttgacacttagtttttattcattttgagatctaagactgaaaagtctacttgtttaaatccccaatcacctatttttttcttaaaaagtgatttatgtcataccactgtagcaaataatatgttaatgtttgtttcattttcctgaaagaagtaatgatttttacttagtggttaaatattttataatgaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagtggctcatgcctgtaatcccaacactctgggaggccgaggtgggctgatcacttgaggccaggagttcgagactagactggccaacatggcaaaaccctatctctactgaaaatatagaaattaactgggcatggtggcgcgcgcctgtgattccagctactcaggagactgaggcacaagaattgcttcaacccgggaggcataggttgcattgagctgagattgcaccactgcactgtgacagagtgagactctgtctttaaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagagaaggaaccctgctttgttttttttctttctctctgtaattgattagattttctgtttaatttgtgcgagttatttttgttaatttttttttttttttacttaatttcttttagaaacatgtcattcaggtttatcaaaaggtaggatttatatatacacatttatttttcaatcctcactcccaaatggctcctgcaattaacattaggtttggctttctggccctgttttttccttataaactaaactttctgctgataactaaatacttaattccttgaaaggaaattgaaaagaaatagattaactctgtcaggcattttaaagggactatggtacccatgcaacaaaaggctgatgcatgctctgtgtattttctttctttggtagaattatttagcatccaaataattctgtcttcatactaataacacttagcatgctcctgtttgaagaatgagatgctcagtaatgttaatgtacaattaatgattatccacaggcatgcaaaaggtaagtattagttgtgttatttttatttcactgaggatggaattagcaaaaggctttaaaatgacaggaaaattagctaatacagaaaacaagcataaaattcaaagctacagcctcatttgatttggctttttcagaaattaaaatgtgaacagctgcgtagcagaaatgttttaatattttcagagttgaaagccactttccagcaaccactgaagaaagagtatctcattatttttacttaaagcactacagaaagtggtgttctgattttattaatattttttaggccaggcatggtggcttatgcctgtaatcccagcactttgggcggatcacttgagcccaggagttcaagaccatcctggacaacatggcaaaaccccgcctctacaaataatataaaaattagccgggcatggtggcacgcatctgtggtcccagctactcaggaggctgaggcaggaggatcacctgagccctgggaggtcaaggttgcagtgagccatgatcatgccactgtgctccagcctaggggagtgagaccctgcctcaaaaaagaaaaacatattttttgatggtgataatcaagaaaccaaaaatattgctttcttaatgcacacatgaggcaggaaatctttcctgaagggctacattgtacctgtgcctctcaagtcaccagaaggccaagctgcaggtcaaaactgcgggaaaagcactttcttcctgttggcagttccattctattattattttttaattgatcttcccacttgtctgatttttccttggacagaacaggtaataactgaatatagaatccagctgatagcctcattggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaaggtgagggaaatgatttttacttaaaatttttttcaggtgtttacttcatttctgtggcagaggcgactattttctgaatgttccctactgtattcctgctgtctctgtaggagttacgtagagagggtggccacaagggggcgccagcctgccatgagcaccgtccagatccagcttggcctccgctctacatttgtgtttgtgttcaaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatgccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttgtaacccatttagtatctaacgtggcattttatacataggaagcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctggcaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaagttgagcagaagtaatgtgtatgaaggcttggggccacgtggaccttcgcaggggtcccagcattttgtgattaccagcatattttttctcccaaggcaataaagagagaagatggccctcatggtgacccaagaaggaagggaatccagagcagctgcagcttaaccctgggagttgtggcacagccctatggagaaacaccaggtcttgacagttctgggttggttctctgtgaagtatgtaaatttcctttctcctttcttgtgattcagtacatgaatcagacctgcagcttttgtccaacacctacatggttgtgtaggggtaatgagctcataactcattgtgttgctttattctcacagggaagttgtcacactgattggtgtgctattctgggttctgggtttgttgttggtcagagtatgaaagtctggaggccggacacagtggctcacacctgtgaacccagcacttttgggaggctgaggctggaggaacattgagtctggtagttcaggaccagcttggacaacatggtaagaccccatgtcttcaaaaaataaaaacatgggccaggggcggtggctcacgcctgtaatcccagcaatttgggaggctgaggcaggcggatcacaaggtaaggagatcaagaccaacttggctaacacggtgaaaccccgtctctactaaaaatacaaaaaaattagccgggcatggtggcgggcacctgtagttccagctacttgggaggctgaggcaggagaatggcgtgaacccgggaggggagcttgcggtgagccgagatcgcgccactgcactccagcctgggcgctagagcaagactccgtctcaaaaaaataataataataaaataaataaataataaaaacatcagccaagtgtggtggcacacctgtggtcccagctcttcgggatgctgaggtgggaggcttgagcccaggaggttgaagctgcagtgaactgtgattgtgcacagcactccagcttgggcaacagaatgagaccctgtctcaaaaaaaaaagaaagaaaaaggaaaaagtctggacagtcaatcagaaatattgttgtctctctctagcgtgggcaaggcactgttgtgattgagatcctcagcaaaacagacacctctctccttgagcctgacattctaggcagtggataaacaagtaagttacctagtatggagcacagcagcacgtgtgagagagcgcagagcaggcacgggtttcatcagcactctgggtgtgaagagtgctgcttgggcagaggcctgggtgggcacgttcacacagatttctggggaagagcactgcttgggcctgaggcctgagtgcatggcgtgcctggagcagagcgtagagatgcttctcctacatggcagcagctgaggggatgacaagggccttgtggccttgggctttcagaggatcaccaggcagctatgtttggaactcactgaaatggggcaaggagaagctgggaaagccgcctggaggctctcagcagtaatacaggcaagaggtagtgcagccttgggtgaggatgggccttggcgctgatggtggttgggttttggacatgttttgaaataagaggcaactgcattttccctggagttggatatgaggtgagtagagccaaggacagcttcatgatttttgatctgaacagcaaaaaggccggaattgctgtttgttgagatgcggaatgtggctggggagatgtttgggaacaggaggggaagaagatgaagagagcaagctggaatgtgctgagtttgaagtccctttaaacactgagtggcaacgtctagtgggcagttggataaacgtgaggggttcggccaggcgcagtggctcactcctgtaatcccagcacgttgggaggccgaggtgggtggatcacgaggtgaggagatcgagaccatcctggctaacacggtgaaaccccgtctctactaaaaatacagaaaattagccaggcgtcgtggcaggcgcctgtagtcccagctactcgggaggctgaggcaggagaatggcgtgaagccgggagacggagcttgcagtgagccgagatcgcgccacagcactccagcctgggcaacagagcgagactctgtattaaaaaaaaaaaagtgtgagggttgggagaggtcgggtctgggagagaccataggaagccctcagcaggtggaaggctcctgctcaaagctgtgagacagaggagaaaccaggactgagccctggacacagcacggggagaggccccggggagaagaagtgaagctggcaaggcagcagcaaggagggagggccctccaggtgtcaggcaggtggacatcatgacctaaggctcaccttgcgggaactttctaacttgacttttagcaagtaagtccccttccctctctctgtccagtgcctttcagagtggagtcctctaacggagctgattgtgcccagtcacagacagtgaggacttccccagctttttttgcctggtgcaagctggtttttatatcccattaaagcatcataaagccaacccggacaagagaattgggatgtctctctgcacacatgagcctttttgtttgtttgtttgtttccccggagacggagtcttgctctgttgcccaggctggagtgcagtggcgtgatctcggctcactgcaagctccacctcctgggttcttgccattctcctgcctcagcctcctgagtagctgggactacaggcacccgccaccatgcctggctaatttttttgtatttttagtagagacggggtttcaccatgttagccaggatggtctcgatctcctgacctcgtgatccacccgccttggcctcccaaagtgctgggattacaggcgtgagccactgcgcccggcacacatgagcctctttaaggagatctacacacagacttctctccccctttgctgtccttgtctgtcactgtcccttctgctgagcagaaaaccaaggagatgttctgccataaattacttcctcctctgggtagatgtttctgagctgttctatgaaattcatgactacgaaactgacttccttaagattcctaccccaaggccaggcgcaggggctcatgtctgtaatcccaacaatttgggaggccgaggcgggtggatcacctgagttcaggagttcgagaccagcctggccaacatggtgaaaccccgtctctacaaaaatataaaaaaaaattagccaggcatgtggcgcacacctgtaatcccagctactcgggaggcggagacaggagaatcgcttgaacccaggaggcgaaggttgcagtgaaccgagatcttgccattatgctcaaacctgggcaacagagcaagacttcatctcaaaaaaaaaaaaagattcctaccccagaaacacccatcacagcaggttcctgtgcataatttctgcagaggtggagcagagccctgccaagcagaggctgggccacagcggacttcctcttccttatctttgtagctgggactgattttgaattgttttccatttttgcattctcaaggacacattgagtactagaagttaaattcctttaagaaaaatgagtttctggaatgccctgatgcagtggccactctttatgctcgtattttcttgaggggctcacttgtcataagcagtggctgcgttttaatgtgttacttggtcaaataaggagtgcgtgtctcagagactagtattcatccacagaaagttacccaagtgcgttatgtttataagactatgttactaattgatcttggcttgattttcatggcaacatgggtagtattccctttacgaaggttaaaatgtgaaaactcattcattactaaggttccaggccctttctatagattctccattctcagaatgtgacatttttattctgcatacaatgaattttgaaaagggatattctacgaccattgaaaatcaaaagagactgcatttttccctcatcaaccacctggaaatctctcagaagtgaggtgagacacctagtggggctgtgctgctggtttgatttacctgccaagcagagcattctcctaatcctgacaatggtgttcctcttcgttgagtgccgacttccctctcttctacatcaggcacattagaggaaccaaaaccatactcctacaagtaagtgaggtgcccagctctcaggccacctttgcatttctgaaagtgagggtccatgcagaaaactgttacagaaacatgactggcttttaggagcacagccgtgatcattttcacagcatatgcttctccaaaagcctagacaataatgatttctattttattttattttatttttttatttttttaagacagagtctcacgctgtggctcaggctggagtgcagtggcgcgatctcggctcactacaagctccgtctcccggcttcacaccattctcctgcctcagcctcccgagtagttgggactacaggcacctgccaccacgcctggctaattttttctattttttagtagagacggggttttgccgtgttagccaggatggtcttgatcacctgacctcgtgatcctcccgcctcgacctcccaaagtactggaattacaggcgtgagccactgtgcccatgatgatgcttagaataatgatatttagaagaaaaacctccatacatgggcctgtgaataaattatagtcactatggaagctgcgtcaggcagcccctacccagtaagcgaccttcgtgctgaccttcaggtctgcagagcagttgccccttccatgggtgtggcaccaggcagagcaggggcagaagaggggtgtttcccacgcactgtcccttccagtccgtctcagaggggcatcaaaatgagaaagagcttgtgctcaagagttgaaaccttacgactctgttgcaggttttttgtttctttcattgctggtttgccacgcagctcaggggccctttagacgggagagattgttgctcttcaagggagtgaagtgaagatggtgccttagaggtgttctgacagtgcacggggagtcccggagtgactcctccatgagtggaaggaactcagtgtcattgccagtcgaggagaaaggaaacagttcaacagctatttttgtttgttttgtttgtcttgggtttgttttgtttcgttttgtttttgagacagggtttcgttctgtcacccagactgaagtacagtggcgcaatcacagctcagtgcagccttgacctcctgggctcaagtgatcctcccacctcaacctcctgagtagctgggaccacaggcttgtgcccagctaattttatttttcgtacagacagggtcttgttctgttgcctaggctggtttgaattcctgggctcaggcaatcctcctacctcagcctcccaaagtactgggactacaggcgtgagccacctcacccagccccaacaactatttttgaatggttccttgaaaagttccattaaaggccaggcacagtggctcacaccaataatcccagcattttgggaggctgaagtggatggatcacttgaggtcaggatttcaagaccagcctggccaacatggcaaaaccccatctctactaaaaatacaaaaattagctgggcgtggtggcatgcacctggagtcccagctacttgggaggctaagacacgagaatagcttgaacccaggaggcagaggttgcagtgagccaagattgcaccactgcactccagcctggatggcagagccagaccctgtctccgaaaaaaaaaaaaaaaatcacacactaaccctcttctcttcctccctctcctggcttagccagtgcagtcaagtccttgaatggcgtgctccctggccctcaggagaggacattgcctatcgagtggagacttggtaaggaaattgttcccatttctaagatggagagttctggactctggaccttctattaggagtttacaggcctgtactgccacctccctgggccagagcttttgcagatattcctagagaacaggtaaaagcaatgagcttggggtaagagcttagaccaactgaaggctctctgcctccctcctcctctaagaggcctgccctggctgtgacaccaaaaagcgcactcgggcctctgtgcccaactctgccctttcaccatctgcccctgtcacaccaacgtcagcatgagttacacagttgtgttgccctttgtggctactctccccacacttactagaatgtgagccccatgcggcagcgatcttcatcctttttcttttcctctattccaagtacctagaatagtgcctggcaaaggcacttagtgcacaattagtgttttttaaaaaaaaaatgataggaagcaagcaggagatacatagcaagtacaagacattttcagtggcttgcagtcaaaagtgtcactgaggtccccccagctgcccctgccccggctggcccaaggatgagataggtggctgctctggggtcatgtcttgctttatagcctggcctgttgggtctccaggagccttttgagtcttgcctgtttgacagagaagactgaggcccagaggacggaagggatgggactggcacccagtgagcttttcccttcatcaagatgcttacacaggtgatgtccatcattcagcttgggtcaggtgcagaccatgcacgtggtggtggtgcgtgcgatggacatgaagtagctgaccctgtgtagagatgacatttcccatcgggtgtggaactgggagttcaaccctttggcttaccaccctaatctgcatccacactagagagtcacacagcccaggtagtatttggatttcaaccccgggaaagaatagcaacctgccgcttggtggcagcatgggagctggggtttagtgaggaggggaagcagttgtgtaggcatcagcagtcatagcaccaggccgaggcgagaccctccgagcggagtccggctggttaaagggcctgcacgggtctctcacagaagaaggaaagctggtcctgagggtggagccaggggaatctgggggccacttcagcattctttgttgccattggctttggttcagtaagctttgttgatttattttgttgttgttattgttgttagagtgatggggctgattgcttataagttctgaggttcttatttgcgtttccagctccctgggtattcattcatacctggtttctggctgtggtgaaatgtcttctgaccaagtgggttgataaacagggggcttcgctggagcgggggcagggggcgcggtcactgaacagagaaaaaactcaactcatcctcatctctgaggggactctttcccccagccagtgccttctgcagtttcctgctctatctatattccacccacttaacccacctctaagagttattttaaaacagcattctagaacccatctctcaagcaagagggaagtctccaatggctcatcctgtgccccgcctgcatctgcgggcacctgcagtgccgggacgctcacagcccgcccccaggacctgtggggggagttcagctgcttcggctgcttctgctgctccgcgtgcacatgggcctccttaccaccctggcagtctcctcctcttggaagttttaactattcaagactcaatggccaggcgcggcggctcatgcctgtaatcccagcactttgggaagctgaggcaggaagatcacttgaggtcaggaatcgagaccagcctagccaacctggtgaaaccccgtctctgctaaaaatacaaaaaataataattagccaggcatagtggcagtgcctgtaattccagctactcaagaggctgaggcaggagaatcacttgaacctgggaggtggaggtcggagtgagctgagaccacgccactggactccagcctgggcgacagagcaaaactctatctcacaaacaaaaacaaggccgggcacagtggctcacgcctgtaatcccagcactttgggaggccgaggcgggcagatcacgaggtcaggagttcgagagcagcttggccaacatagtgaaaccccgtctctactaaaaatacaaaaattagccgggtgtgttggcacgtgcttgtagtcccagctacttgggaggccgaggcgggagaatcgcctgaacacaggaggcagaggttgcagtgagttgagaccacgtcactgcactccagcctgggcgacagagtgagactccgtctcaaaaaaaaaaaaaaaaaaaaaaaaaagacaagtatttgaagattaaaaatgtgttccctctctgaattctttttttttttttttttttttttttcttccagacagagtgtcactctgtcgcccaggctggagtgctgtggtgcgatctcagctcactgcaacctccgcctcccaggttcaagtgattctcctgtgatctcagctcactgcaagctccgcctcccgggctcaagcgattctcctgcctcagcctcccaagtatctgggattacaggcgcccaccaccacacccggcctcctccctaaattcttgcttctccaagttaagctgccccagttattttcaggtgttctagaacaagacaggaagacttctcatcaatcatttgttcatgtgttcattcattgtagccatattttgagggttaaggtaggagaagcacctctgtgctgacccctggagatacaaaaataaacaaggtaaaacctcctggcctcgactacctcatcgcacagggaggcgaggggcactggtgtgatactaggatgggctgatgctgcgttcaggaaggccagggccctggccgaagggagtcaggcctgggtacaggggaggcacgtagaggtggcggtgcaccgagtccgctcagtgggagagagaggagtggcacgtgcagaggcaggcgccaggggcctggctcatctccaactcaggcgtgggggcagcggctgggccgccaactcctgggcaggctctttcttgtcactagcccaacatgttatgtctcagactctgagacactgcacttctgtgaaggggccttcattccccagtacttcattagggagtgacctagcaggctttgggcagggttgtgctgctgccagaccaaagcagactaatgctgcaccagacagccagagcctggcgaacccagagagcctggcatgagactgcctgtgctggcgcctaccaaagcaaggcctgctctgactcgcctcagcctcctctcaggaggaagctgccagcaggcgtgggtaggcgtgagcacattctcaaagcagttatgttttgcatggaagtcagctgggaagtaggagcatatgtagtcatgttcattaatgtggcaccagaagtccctgggtggagcatgcctcagagagcatttccaacccgccaccaccctccactccaccccttcccaaacgcacctgtgcactccgcgagttctgctctgccagtcactcccctgctacaggctggcctccgctgctctttagtacacagctcggctgtctctgggacatgtggttctcgtgctctccaccctaatccactggccactcctctgctacctccattctgtgggctctagagggctccaacaagcttgtcccatgctgctcggacatctcctcagcctgtcgctgtgggtgggagttgctgctccccagaatggtgatgctgtgtgtccttttgtgttgatatcactaagtacatagggcacattttgctggcttgcatttcctggtttgggaatactttatctgaaatgcttgggaccacccacaggtgtttcgggtttggggttttttcagattttggaatatttgcattatacctactggttaagcatcccaaatttgaacatctgaactctgaaatgcatgagtgagcactcccttttagcattacatccgcactcaggttcaggttttggagtattttagatttcagatgtttggatttgggatactccacctgtatatttcattaatttaaccaaaacactggaactttgctgacaaagttagtcatgttatcctgtgtcaaggccaagagaacagaggaaagcaatccccatgctcctttctgatcccaaggaagagtgaatagggtcaggccagactctggcccctctgccacagcgttttgtcccccaggtaggtgctgctgctgtgacttgggtgggggctgcagcacaggggtccctcagaagcacagcagttttggggccaggcagagtggctcacacctgtaatcccagcactttgggaggccgaggcaagaggatcgctcaggccaggagttcaagaccagcctgggcgggcaacatggcgagacaccccgtctctacaaaaaaaaattttagaattagccagacgtggagatgcgctcctgtggtcccagctactggggaggctgaggagggaggatcacttgagcccgggagattgaggctgcagtgacctgtgatcctgcccactgcactccagcctgggtgacttcaagaccctatctcaaaaaaaaaataaaaaataatacattttaaaggaacaattttgggtatagatgagtagcaccacctttattatttcttttttttttttttttttggttgagttgattgctatatttcttttctttttgagagtgtaacacatttgaagtgccatttaatatgttgggtagtcgatgggtcaaaagtattgacaaaactagacttttcattttaattttaatgggagtttctgtctttttgctataagttgtatatttccggaatagctttgatgtgtgttaacacagaccacatataccagtaatgggtgcagctgagtataggtggaatgagagtaatgaagcaagacctaagccctgccctgggagcaggccgcattctcaagagagaaggctcaccagcccagcagtcctctaatggggaagagacaggacagagccggaggggaagagggatgcagaaggaggccctccgggaaggaggcctgggcaggcagggcagtcctcccagaggggattcgggcgattgtgggaagcagagagcagacatgcaggtgggagccctgccccaggttaggcaaacaggcaacaaacacgtctggaggggttggtgccgtcctgagtgcaagtgggtgtggagtacctggagccactgggccaattcctctgcaagcccagcaggatcccaagccgaaccccacgctgcatgggattcatgaatggtagaacagggttgcagccccttcaccacagcaggaatgttgccagcacctcaggagttggtgccaggctgcacacacgcaggcatttcgccccacagcaccgaggacggccttgtcctcacagcctgggcagctgctggagcacgttgatacctggccacccctagctgcatgggagtcttgaaagtgtgctttcacagccaggcagctgcgtgcaggctggaaaccagggcgctgtcactcaagcagaggggagaatggctgctaggggaccaccagcatccgtgccatgaaggtgaatcagagacaggtgccactggcagtagcacttttatcttttggggggccttaatttttgttaagccttaaattttggtaaatccccaggcctgaaaagggtgtgaaaatcaggacttctgaacccaagcaaaacaatacaaagttgggtttggggaaaaaggtggaaagagtccaaccagctgggcacagtggctcacacctgtaatcccagcactgtggaaggctgaggcaggggaaaggcttgagcccaggagttcgagaccagcctgggcaacatggcaaaaccccgtctctacaaagaaaaaaaaaatagaaaaaattagacaggtgtggtggcacgtccctgcagtcacacagctacttgggaggctgaggtgggaggatcacctgagcccaggcaggtcaaggcttcaatgagccgcgatcgtgcaactgccctccagcctgggtgacagagtgaaatcccgcctcaaaaaagttcagtcactgcgagtgcagaaagcctctagccagactgagaagtctgcgtgtaaaaaacctcagcctggccgggcacggtggcttacgtctgtaatcccagcactttggggaggctgaggtgggcggatcacctgaggtcaggagtttgagaccatcctgaccaacatggagaaaccccatctctactaaaaatacaaaattagccaggtgtggtggcacatgcctgtaatcccagctactctggaggctgaggcaggagacttttcttgaacccaggatgcggaggtttctgtgagccaagatcgtgccattgcactccagcctgggcaatgagaccaaaactccgtctaaaaaaagaaaaaaagcctcagccttctcagcagtaccaaaaaagcctcacttatctaagctgaaatgctgtcatctgctcagtggaaacctcacggccaaaagacttcttgccaatcaaattactgttttctttttacctgtagaaaaggagactcacttcacatccatgtgggtccaatgtgcaacccctgaagggtgctctgggaggctttaggaagtgcccgctggctcgaaatagaaatgcagaaggggcaagtgcagccttttaagccactgctaagacaagcaggtcccaactgtgggaggctagaatgttctcagaagagcagtgaaaagagcccaggagttagagccggcgaggccggaccggtctgtcttcctctctgaacctgagtttccctgtctgtgaggcctcaggccgtggtagtggtaaagtcttgctgctgcttggtgggcttccgcagactggaacacatgacagcattttctacaaaacaccattaaaaacattattttggcttatataagtaatacatgtgccctgtagaaaatttggaaaatataaagaaggaaatcacctgttaccccaccacccacagtgactactgttctttggggtttttccatacatattctgtgtgggatctcagagcacaagctgttttataacctgcttctgctcttgagcttttctcagcatgtcaccacctcactagattcctcacactgtcctccctgtctgcacaggaccccagaggaggggtggggctgtagccactcttcagtgtcagcaagcccttacagtttccctgttctcagtcattgttcacttatatttctgtagggcaacgggactcgaggaaggggggctgttttgccccctaaggggcatttgtgaatgtctagacattttttattgtcataagttggggaagcgaggactactggcatgcagcagttggaggccagggctgctgctggacgtcctgcagcgcacaggacggcccccaccagagtggtccggcccaagtgtctggagcgccactgcggaaaccccgccgtggactccttccctagctgggaagtccctgagtggacaggagggacagctgaggtggggcttggtgcagccagattgccctgcagggagatgtgtccaacagccagaacatctccctgtgtccctgccgcccctagatactgtcctttgctgtccatgtttgacagtgctttcaaggagaattgcctgttaaagtctgcggagtctgaggaaaaaggaaggctgtctagactgtggttggaggctccgtggaactagtggcacaggcagacgactgtagctcccccactgaggggagtgtattttaggccctgcctggtccccaaaagaattaatgcagtaagataaaatacgtgaggcacagggaggagagtggggcccggagagctgggggtccaggccctgtgggcgccacaggccagccaaggccccacccaccttcagagttttactgcctcagaagtggtcctgagccaggcccagccttctcggcctccccggacagtgcgttgagaggcctgcatggggtgattaggggttccgcttgtttgaccaccggtggttctaggagtgccccactctgagagtcaacatgggaaaaggggagcgttgaaacacaagtgttaggcctgcccagccatgccctcagccctgtgttcacctcggagtggggcccacaccaccccagcgattgtcaggctggctctgcccaagccgtgatgagagggactgagccagcaggaggggctgccgctgttgagcgggaggagggcagcactgacaaggccccctgggggtggggctttgctggtcaggtccccactgggtctgcaccccttcctcactgccctcagcctcccctttctggaggggctcacttcctgtgctcacctcgggcccttcgtccccgcccttctcccaagactctcgattgtacagctcggcctatcctggcccgggccttcctagcaaaaggctaagccagaaactggccttgtgcccaggctggtcagccagggagggcccagtctagggtccaaaggctggatgcagaagtccccccagccttctgcaccaggggacctgccccctatgcccctagcctaccaggtgttcactcagggaggtggacacttcaaccctgcccttaggaccccccacaagccaagcccagcagcagattcagggatgcaccccactgctgctcctgggccccagtgtctaggttggcaatcccctcgtgtcccaaggaggtgagagcccagtgatccgcagcttttagtgtccaggtgggcatggagatgcaggatgaggcctgtcccagaccctgatccccaggggtggggcagaggaggccctggccagcaggtggcagcacaggctgcgtccttggcgcttaggagctggaggaaggtggggagcaggattcctagcccccgctggctcacctatccgcctccactccctgagctggccgagcccctcagggtgcccaatcatggtaggagccctgagccagaggctgggcagggacagtggcaactggcaactagggtgagttggcgggggggttgcaccagggaccagggcgaccaagccctaaacagccccaaccccccttctgcccagggtccctaccttgtggttccaccttgaggccaaggggctggacacccagaggcccctgaagaggagcctgccagtaaaggggggaccagtggctccccagggctgctagagggtcttgaggactgagcccaatgaccagtggagccaggggggctgttcagcctgaaggccgaggctgggagggaaggaagcagggaagagaagatagagagtaggtgttggcggggtaggaaggaggcagggagatgcctgcatctgatagtgttgcagcttggaagactggaggaggaagccagttggagggaccggaaagctctcaagtttctgaggtcaaccccccacctccactatccctacctcccccaccctgcaggatgggcctgaggaacgtgccaggctccacacccaggcctgaatgccctcagatgctcaggcctggagctcctccctcgctctctcccatgttcctgcctgcacagcccgatagacacgagggaaggggcccatggactaggtagggcaggcagaacagagtggccacctcctggctcttgtcccatctcacagaaggcgaggcccacagcaggcccaggactcaagactcctggggcctggctgctgcccttccccctcccccctgggaaaggagaggcaccactcagacgcaggcaggccaaaaccctagtttatttcagcatcagcagtatcttagccatcaaaaaaataaactctaccaagggtgacggaagtctctacagcaaggctaagggctcgccagacggcgaacatcaggggtgcatggtgggcactgcccaggcaataagttaggaagcagcagggctggtgtcgggtgtgggccgggcttcatttctgggcaggcatgaggtcgtcgatggcctggccctgctccagccgctgctccatctcgatgagcagcttcactccgtccaccaccatctgcaccagctccacctctgagaagcccaggcggtcagcgttggagacgtcgaagaccccgcccaccgcagccgtgtccacaccgcctggggagacagcaagtcagggcggaggaaacagggctgcccaaaggccacgggaagccgcagcacctgccctgctcacctgtgcctcgcttctgaagtcgcagccgcttaagcacctccgagaacttctcatgcttgcccaggttgggcagcttgatatgcacacctgcccgcagcccggtgcccaggttggatgggcaggtgaggatgtagcccaggtgagggttccacatgaactcatagtccttagacttgaagagagtttcaatctgcagacggagaagagggtatgagggagaaggcctgcctgaaacccctacaggccctgagactccccagtgccggaaatcccccggggggactgatgctggggcacccacatccctgctggggccctggggtctgggcctgccccgtccctggcacctgggtgaggccggtgcagaagcgggtgaacacctccttcatgttgccccccttctgcatggagatgacccgcaggtggtcctcctcgttgacccacaccaggaaggtcttattgtcattgtgcctgcgggagggctggtctcagggcatacccagaaaaaagccccaggccgcccccagaccaaaggaacttcccaagtccctgaggtgctgctccctgccatgcccaggagtggaggctgctgccaagactccacccgccaacacggggcgggcgggggaaccgggacgcctcacagcaggagaaccccagctgccatcatgcgctgtggcctgaggtggggcggggccagggaccgccaggacagcccgacccgccccccacagtgggggtaggagccctgcccctggagaagctttggcgtcaccagcccctggtagaatcccagcggcggaggagtgagaaaagaaaacaaagagctccagctcccagggccgtcggggagaggcgccagagagccccgcccccacctcacgtctcggggtggggaggtgttgctgagtcctgagcccccacgggccggggcccagtcccttaacgcacctgctcggccaaggtcaccggcgcaggaggaggcgcggcacggaacccagacccggagcgcggccggcccctccctcctcctcctcctcctcctcgccgcgaggggccccacccccgcgaggggggcgagagggaaagcggaggtagcggggagggaggacgccgcgagagggcgcagagggacacgcaccagataccgcgggcgtcgggccagtcgcgggccatgcccgaggccagcagcaggggcgacacgggcttgtcgaagaggaagtggtcgtcgatgagctgctgctgctccgcctccgtcatgctcttgagcgcgtagtatcggcccgccaggtcgccgtccaggctggacagggctgcgaggggtgcgctcaggacgctcggctcccgcgcccgcccctccagcccgcagcgcggacccgcccgcccccgtgccccacctcgggggacgtcagagggccccacccgcccggatctgcgggcgtccagtcctcacggcccgggcgacggtcccaggcggtgaccccgcgccaggacccgccctccctgggccccaggccgctgtgggcgcggggctgggcctccgtccctcggtccctccgggaaactgaacccgggcgcgcgcagataagagcgcgacggcggctgccgctcccgggcgacgtaaacaaaagcgggcggggaccgcgccgggagggggacgcggccgccgccgcccctcggcccgcccggcccctaccttccaccgcgagcttctcgatggcgcggcgctccccgcggctgcagtgcggggggaggcagaagccacggatgctgcggcccgtgcgcacccgcgagctcagcacgtagttggggtccaggtcgtcgccgccctgggaggcgagacgggagtgagcgcccgaagaccccggccccgcccgcccggcccgcccgcagccccgcacctgcaggttgtcggggttgaggtcggtcttgtgctcatcgctgggcttgtagccgccgtgccggtcctcgatgatggggtcgaagagatccttgaacacttcgtaggactcctcgtcgcccgccacgcagcccacggtcatgatgtacgggtggcctgggggagggggcgcgggacggggacagtgacgtcactgccgggcccgagcgcgctgctgaggaccctgcggctgcgcggggggagggggggccgggaccccggccccgaggggtcgcgtacccgggttgtccacgcctgtctggatgacgtcgtccagcgtgaagccgctcggcgtgctcttggcgcgcagctccgcgtacagctcgggggtcagcaccttggccatgtggttgttgtgggcgctcaggtcggggaactcgtcctcggccgggaagcgcagcttcagtgcgttgtggctgttggagaagggcatggcggcggcgggctgcggggagacgcggggtcagaggggaccggcacgccggggttcccgggctcccgcgtaccactcaggcccccgccgccgggccccccggcgccccccgggacgcggccaaggtcagcggggtccgcagcgcgcgcggggagcgccatcatcgccggggacccccggccggtccggcgcgcgctccaggcgacgcgccccctttgcacgcagcgcccctagcccgggcgcggacgcccccggcccccgggcccactcaccgggcggccgggcgggggcgggggcgctccgtccgtcggcagctcccggagcgacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcggagagcctccgggcactcgaggacgcttgggttcatccgcatcctcgagcctgcccgcctagtccagccagcccccgcggcggcggcgaggggccgggcgaaagctttcggggcttccgcagcaggtacggcccccgccccacccccggccagtgcgagctggcccggagccgccgaccttcctcaaggtgcccgcaggcgtttcctgggcgatcctggtgcaaagcgaaggcgcgcgggaagcgcagtctggctgcggcccagcccgggggcacccgcggtgccctgaccttggacaagtcctgggtctcggggggctgcgagccagaaaccacggggacgctgtggccttaagaggccgctggcaagtgcagcctcggagtttccagaccccaaccctgggccctcttcgcaggggacaagtttacccgacccccaaaggcagtccccggagacttcaggcaaagatgggaggaaacgctaataaacaataagcataagtgcgattaaaaaaaaaaactgatctcacgaataaccagaatcatgcaaattaagcagtgactccacctgcccctacccccaacactcccagatcgaccccagccattgctggctttgagctggaatgcgggaagacaggcgtccacacgctgcctgcaacttaaattgctgcatgctttttgcaagataatttggcagaatctattaacgttaacaatgttcgaactccgtgacccagcaatctccccttctaggaatgcagcccttagaaaggatgtctcagttctctccactaatggaccaagagatctgtggagggaaaaacaaacataactggatacaacccgatgccccatcaggcgggagtggccaagggtagggaggcatctgcttgctgtggaatattatgcagctgttaagagggggaagtggaggatgtggggttaatatccatcagggaccctcatctgttgctctgtgaataaagcaaagaaggggggaactcttatctgtgggtatatttgatacaaatccctccagcagtggcacaatgagcacctaacaggtgccagccgctggggatacagcaggcagcgaggtacacagcgcctgctgctggaagaagactggccatgagccagcagcccaacaaaccagatgacatcagatcggtgctgctggggccagggggacacagagcagtggcgttccaggtataagggaccccgaataggtgcctcagagcagaaggcaccagagccaaggcccaaaggcaggggaagcctgttcgcctctgcctatgtgagcatcggtgtgggggccttttctcctgtctcatccccatggtcactgcagaggagacacatgcctctttgctccttggcatgcttcgtcctgttccaagccagcattttttagacttaataaaaccaacccatgtaaaaaggcaaacggcccctctgggctggccagacagcaggtgtcccttaagcctggaattcctgcactctgtgccccgtgcagcctcttcgcccagttttagaaatttctgcagctgcccacctgctaccccacaaaacctgaagggcttaagtttctgtttctggaagggatagctgcagcccctggaggcagacttggggggagggagagacttgggggccacactcaggacttcctctgtcttcagcaactgcagcttctcagaaggccaaccctcccctctctcaccctcctggctgagagcctaacctgcttcccaggtcccccatgggaaaggaccccctttcccctttcctgaagggggcagcccctccccccaacacctgtggttatttctcgtcaggtgggatgagactgagaaaagaaataagacacagagacaaagtatagcgaaagaacagtgggcccagggaactggtgccagcatatggaggacccgcgccggcactggtctctgagttccttcagtatttattgatcactatttctactatttcagtgagggggatgtggcaggactttagggtaatggtggggagagggtcagcaggaaaacatgtgagcaaaggtctctgtgtcataaataagtttaaggaaaggtgctgtgcctggatgtgcacgtaggccagatttatgtctgactttacacaaacatctcagtgcagtaaagagcggtattgccgccagcatgtctcacctccagccataaggcagttttctcgtatctcagtaaatagaatgtacaatcgggttttacaccgagacattccattcccagggaggagcaggagatagatgctttcctcctatctcaactgcaaagaggccttcctctttcactaatcctcctcagcacagaccctttacgggtgttgggctgggggatggtcaggtttttcccttgtcacgaggccatatctcaggctgtctcagtcgggggaaaccttggacaacacccaggctttcttgggcagaggtccctgcggccttccgcagtgcatcgtgtccctgggtactcaagactggagaatggcgatggctttcaccaagcacactgcctgcaaacacattttaacacagcacgtcctgcacagccctaaacccattaaaccttgagtcaacacagcacatgtttctgcgagcacagggttggggctagggttacagattaacagcatctcaaggcagaagaatttttcttagtacagaacaaaatggagtttcttatgtccacttctttctacatagacacagtagcagtctgatctctttctttcccctacactttccctccacaggcaaggtcagaactgcagatatgagatccagagggcagggctgcctatggcaagcagtgagcctggcactggggcggctccggcctggcgccgctggtaaccctcagctttctgaggtgggtgtttttgtccccagtgtgcagacagaagatcattttatttttgtttttattctgttgagacagggatcttgctgtgttggccaggctggtctcaacgtgcagatagatcagaagttgggtgacagaggtgtccagtcatgggcccagcaatccttccaccctcccagagcgccggccctgtgcgagcctgcctggggcaaaatgacagtgtacgggggccaggcagctgtgacggggacagcagcagcagataacagtggggaggtggccctcaaggccttcagacctaaatgtcagggtgagaccccccaggcaggggctgattgggagccttagtgtcccccagagcaggtgcacaaggagaggggcttggaaggtgccagcctcccctccagctgacctcccctgtccacagcccctgctctccctggggcccacaggggctgctttggcagcatccaggcaggaggctgcatgacgttaccaggccagtgtttggtccaggttcctcagaaatcacacctggttacacgtgaaccactgggcctggagggggcttcaaaggaggcccaggtcttttatccacagaacatgacccggctcagcaggtcaggcacagggcagactccaggcagggcactggactctatccttgtagtctgctcctctgcagagtgcagccagaggcagcattgcttcctcccagtgccctgcccctgagttctgcagagcccgaagaggaagcgggctgaggtcaggagagggacaggggctgactggggatcacagagcacagtggggtaggaggctgtgctgcttagaggggagggactgcagtcacgtggtccctgccagggatttgggcacagcagcctccccagtgggcatccttcctgcctgttcccacctttcttcaaatcagccattggttctctgaagccggtttactggctttaattcttaattaagagatagggtcttgctatgttgtccaggcagaactccaactcctggcctcaagcagtcctccctcttcagcctcctcagtgctgagctttgggggtttattggctttaaatcctaatcccactttgacctcactggctgtgacttcaggcaagttatttaacatctctgagtttcagtttccccatctgtaaagtgttccctccctcctaggatcctggggagaagtcaatgagatggcacagctgggcatatacagcatcagctcttgttaggggagccccaatacaaactctgcacagggaatcatcagctgaggtaggggggattggttctgcttgaggactcaggctggggactggggcaggctcagatggagcaggtgggcagggctgaggaggctgcctggaggaaggggcactggaggagttgaccagccagtaatagacagagaggcaagagggaagtcggaaccaagggaaaccaccgccgagtcaccaagtcctaccttaggcccttataggcacccggccctgactccacaccaaccacagctgagaggctggggaagagaaacccaagagaagtggaaagtcagaatcccccaggggagaaattagggggtgactcaggcgggtgcatcatcaagggagagaagcatccgctggaacacaggttcgggagctgtggagggggctgtttcaacgttgagagcagaaggcagggaggctgtaaggcagaagtagaggcagctggtggccagcgtggtggccccacagggacaggagcccacagagagtgggaggccatggaaggcctctcaccagcttactcctgggggctctcagccgcagctagggcagggacacagaggggctgaggttggacccctaggtttccatgatggaccctgagaagccaatgcaagggccacaaacagcctggcctggcctgccccagaggcgagagagttgagagtgctctacaggctgccagggctccagaggggagctcgctctgcaggagcctggccacctcatcttaccaggctggagtggctgagtgactggggagggtgccctagggtcattgctaactggcttgggttcgggcgcaggctaaaccctaggctgggtaggggggtctctgttcctctccaagctctggtcctgagagctaagagctggaggaagaaaatccgtgtcccctgcccccgctcccctgcacacacactccacagaggagccagctgggaatggtgttgctgagacagaacgccactcccgcttccctgttctgcccatcctccagcagcacctcctccagtctcctgcccaggctgctcaccagacccaaaagtgggcccaagtcatccagttctcattatgccttggttcgcaggaggggacacaggacccctactccctcctagaagcagctctgcactcaggacaacgtgcccccgtcgggggaggcagggcctgggcggaaggccacttctgcagacttttccaggcccccatctgctgcacagagctctggctgaccctagcccaagccttttagaaccgccccttgacctgcgattccttttctggaattcattttagggcccagtcaggggtgttcccagagcagtctgcaataacaaaatgtctatggcgaagtgtcctcatagaggactgggcagtgagccacgggccagccctctggtgaacccccaggggccgtcaaaggggtccgggacagcagtgacagccaggccttggctcctgccgcccttcaaatgtgcctgggtgcgacggcaacccgcggccggcggggcggggggaccttttgtttgtttgttattatttgtagagatggtgggggtctcactacgtttcccgggctggtctcgaactcttcagctcagaagaacctcccgcctcggcctcccaaagcgcgggatcacaggcgagagccaccgcgccggccggccgccatatggattttgtccagtctttcgatcttccagcgaccagcaaatgtaaacagagcagctcacatgagggaagaagtcgcccaggaaacgtcctctgggaggggcgggaagggcagcctggcgctcccaggatcccgtgcgcggagggggggagggggaggcggaggcggggcgcgacgtcatcagcgggcgcggagccggaagtgttgtggccgccgccgccgcgcgtcgcggaggcacgtgtggagccccggcagcaggagcgtcgcaggtgagactccgcggggtacagggtggcagggcgcgggtgagggtgacccgggccgggcacggcgcgcagggcctgtccctccagcctcgcatgggcggcccccgccggcccggcctggccccttgttgcctctgcatcggctgggcggtgtttgcgtggacggccagctccgcgtccccagccccttactggggagccctgaatcctctgtcataccctgccacctagcccccgtgggggagactggggtgaggaatcaagcctggcttggaggtgacctcattgaccatttgcctctcccccgccggtggacacctcgcaaaggcgcttcctcatctcacatcttgggaatgggagtcaagctcctggagaagggtgatgggagggtcgggtcctcactccgggaatccttgggaccgaactccgccattgccaagcctcagtcttttcatctctgatttaggctcatagtccctgtctcttgtcctagaccaagaaaggcttcagaggccaggccagagtgcagcgctattgggctccctgtcaggcagtggcagagactgaggctgagctagccacaccccgcccatgcccactgctgggatgtaggcctcgaagccttctacctagaccctaggccctcatcctgcctcctgacttgctcatgcctacacacacccctccccaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggtgagttcctcaggctgcctcagtttaacgcagaaattgacacaaaggtggaggtcagagcctccagcctgcccttcctacagacacatgtggctcctcagtttctattttcacatctttccgggatgctgacagcagggagtgaaggtggaggcagagaagcccgttaggaggctggtgctgtaactggagtgagaggtggtgggaaatggaccaggaggagctggggaggactggtgctctagtgagggtcctgcttgccttggtggggcgtggccagcttgatgcttggcgctgtcctaggtactgaccgtcaacctctagtcctccgtgctgatggtgaagcagagagagttgccccttctggaaagaggccagggctaccccgaggagctcactgtaggtggggagccttccccatcctcatccatgatcagatcctcacctgctaccaatgaatgtgagcaccattgttgagtccagggcctgggctgtgggaacccctgcacatatacaggtgctggggccgcccagtgtggcgattgaagccaagattggccccaggcgctgatgcatctaggttgttggtggcgtgttcctcccgggcaggagagctagggtccaggttcacgaagagtgcctagcactgccatgctggctttctgagggctgcaggtcaccatgtccctccctggggtgtctgggtgggaggggtggagagcaggacttagccaactccatcagctgctgctcctgtgcatcctgtggtgggtgctggcctctccgcccctgccccactctcgcgagagagctcaatcaagcagcaccttctcctggcctcctcagatatgccaggtcccctcctaggaaccgtgaactagagagaccaggttcctgccctcgaggagggggacacagcctaggtgagcatctcagtgccgctggttgctgtgaagcctgtgagacagggctgcgtgtctgaggggtacccagagtggggactctccagctaggccaggcagggaagacctctctgaggaggggacatttgagttgaaaatgatgaggagggacctacgaagagccaagggacagctctgcaccaaggaggagccgtgccgaggccctgcagttggagcatgctgccgagtcaggctcagtgggggaggcagaggggctgggagtgaggttggaggggaagcgagctccaccccggaggctaacaagtctgacttgccccttagtgggaagggggcatggccaggctttgcagaggggcgaggcagcaggctgggggcacccaggggaggggctggacaggtggggagaggggctggcccctgaaaggaatgtgggaggtggcaggacgtgggacgggatagagggagtggaggcacctccatgggtctggcccaagcacttgcgatgctcagcgctatttgggttccaggcatgggtggcaagtgtgcagtggctgctctagcaggagtctccagtggaggggcctggggatgggagtggcatcaggtagatggcccctgaagctggagtgggaggagggatgcaagccttgaccctctccataagacaggaagtcaagcagaggggccatcttgagggaagctggggagggaagctgggggcaggtgcgctggggaggactggggccgtgtggctggtggccaggccctgcgtcctgagtccaaccaggccagggcagagccccagcccctgtgtggtgggggcaggtttgggcaggcttggtgggggtgggctgtctcaaggggaccaaggagcttctggggagaggtgggcatgaggaccggcagggtgggccactgttgacggggattgaggaagtgatgggccatgcatggaataagacagggctgagtgatgggatggcctccctgtcccccttgcacagatttccccggaggctccaggcagctgggctgctctcattccctatacctgcgctaggcaggatagggcagggttgccactggcctcgcctgtgcccacaacagacagcacggcatacacagcctgtcaaccccagctcacccctagacagggtgcccaacccagggctagcctggggctttaggcagccaggaccatacagccctggaatgacgcccacctgtagcttggggtcctcccaagccctgtgtgggtctccagggtgaggtgggggttgtttcctgggaggctgtgggtcccgagcagtcccaactgatgccttgcccatcccttcttgtcctgccaggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggtgcatccggggttccgggagaggtacagcctgggtgggggtggggcaagggtgcaggactgagctcctgggatctcagaggggtccagagaccaagccacaccatggcagtggccaggccagggccccactttggcctgaggtgaggagtgggtcaggctggccaggggaggcagagctggggaggatggtccctggctgggccctgctcctggtctctggcctctcccaaccccctgatggaggaaggtggcagcgccacccaagtgcagggcaggcccggccggaggagtctggagtcccctccctgctgtttcccaaaacctctcctcccccaggctctggagcccagggagctggccccttttagggaagatgctgggtgcggaggcggggcagccctggggaaggtcgggcctcaagccagggaggtggctgggaggcccagggtttttcccttttctggagaaggagcagctcaggcagcaggggccccttccttcttcccagctgagagttgtattctgagagggttgaagggtggaggtgctgggcgccccaccccacctcaaagatgagccgaggcctggtgcgaacagcaaggctgtggccgggggtcccctgctggctccagcccagccctgactcctgggtcctggtctctgctgaggtgggtagctgtggggatctccacaccctgcctcctaggcttcctgctctggggacacttctgggcctggaccatagtcccagggaggctgaacccggcagagcctcccctggggcccccctgctgcctttgtgactccttcctccagcgtggctcggggaacccgcgcctgcctctgggacctgtccctttccctgcgagctcccccttctgggtccaaaggctcctggctcattcatgggcccggcatctcctgccggccacgggagcccgctggggaggatgcggcatgctcagcctctgtgccctgtctaggctgttgtcacacagcaggtgcctcctctaaccccgaacctcctggcggccccgtgttagggtacagctgaggagaccaaacctcagggacgtttgaggacacttgcctgggccacatacctctacccggccctggcttccccaggtcctccctgccaggacagggacccgggctgggttctcattcactgcaggccaggccaagtgaagcccgtggctgccctggtgggaggcggcagggaggggctgtcatgctcgggctctgcttcgagtaggcgcctcctgttcccgggagcagcgacagcctctaatttcctgtgacagcagcggcccccgcaccgccccacgctgccgtgctgtcagagctgctccgggcccagagctccagcagccctgtggaaggcaggagagcagtgcccgctgtgggccaagtgagacaatggcagcgcgggcttgacccggtgcctggcacatgggagggcctggcatggctaagctgggtgacatgaacagcggcgccaggccccatggggggctgtcagttgagggccaggcccctctgccctgcagtcccagctcttggagagcttgcagtctgtgttggggctgtcttaggctggcctcagaccctagggtgggagtccagggatgctagggccagacgggccaggctctgccacccctgccctctgaccctcgggtcctgtttcccacaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaagaccccttcaaatgtccttttctcagcatgcttccccagacatctaatgcccaggcgggagagtcctgcacaccatgtcccgaaggagtccccatagcagaggagcagaaggcaagcagcgccccagttctgtgatggggagcctgactttcagaggtagagctgggcccatggccgtgagtgaccgatgagcaggcccggatggtcagcgcgagtcagcagcacgggctcatcatggggcacggattcaccagaaactccctgcctggcccagtgtgtactcgcctgtggccctcagattttccctggcaattcctccccgctcaccctgctgtcctgcactgagacagtggcacatgactcccagctgcccaagccctggaaggtcccagaccctggctctgactcagctgcttggagggtcctagtcctgggaactgccctagagccgagattagagtacccctccctcaggaagccccggggtgtcagctgctcctgggcctcactctgccccacccatgcctgcctcagggcccagcccctcacccaagagccccagaggcctgggcccaacctgggcttcacgggtggggaccagggcagggtttctgggtgggtggagggcagcaggccggtgggggcacaccctgtctagtagcatgtgatgaggcagggttgcccctgagggcccaagaggccctcacccctgcagcctaggtctggggctgtcccctccactccctcttctctgcctccattgcggctttgctctctccacccaccacctctgggccagaagatggaggatacgtgggctgccaggggacccgagtcccccaacagtccactgcacaggtagggaaactgaggcacagagctgcaactccggaatcctggccataagtggttccccagtgcatgaccctagagggcagagagttttcaggcagagtcctggaaggttcctcagaaaaggagacacctgtgcaggtggacattggagaagggtgggcaagtcatgcaggggggtgggaggtgccccagaagcagtgggtggagagggtgcacttccagcctctgggctggcaagtgccatttccaaagctgctctaagcagggtgggcactggactcagtgcccccacagccccggggctgttgggctcgcacgccagcctggaggggccttgagcgagagggtccccagagaggggcctggctcctgatgccctcaggagggagtgagcaactgccgggcctcgcgccctgtcctcaccagccacagagggtgggcgctgtcatcagtatgcatgggttgagtgcctcccacgtgccagcccctgcccattcaggacgcccaggcctgcccttcggggctcccaggagccagacccagatctgggcacacagtgcagagtgagctgtggctgcgggagcggtggtggcctggaccctgtgtggcaggtgtgggtcggtgtggagtgggggagtggacgggcctttctgtctcaggagctctgcgcactgcccactcctggacactggaacttagcctcgagagaagtcgcttcccgaggtggccagcgggttggcagcagacaggctgggtgccaggtgtgtgcaccccggagccagcgggttgggccctgcccccggtgggtcatcagtgaacaaggaggggcacagtgggaccagcctgctgccctgccccagcagtggccttgccagcccatgggccctccccacgcggagcctctgtgcccaggggagcctgtgtggcccagcccggtagccaggacgagggcgtttcaaagtcaggccgcctccaaagcagtggcgttggtgggagggaataacttgctcccaccaggctgagaatagctcagaattgggtcacgctcaccgagatctccggtcacagcctccagcctttgacaataatcagctttctccccgacatctgtcccttcaaagagggggcaggccagtgcaggcacttctagaagcagcaaagcagaggggacgggagtggggaggggcgtcctcacctcctggccccccatggcaggccccctccctcccatgctcccaccccatgctcccttccgtgcctcaggtcccaccagcttcccgcgcagggccaggtaggggagcaaagcacggcagtgccccctgacagatgaggacaccagctaggggctgcggggagggtggcgcctgtgcctggccctctggtgctctgccacccatgcccctcagctcctgagacttaggggcctgcatgccactgccccaagccgccctcctctcgcccctcccggtctgtcctgggctcttctaacgtggttgaagggcatgggtcagagcaggccgtcctgctccgccaggcttttgggggcttgtttcccccagcccaggacttcaccccgtgtcttgtttcctatccattttcccgtgtcgggccctcctcatcccagagcagccttgagagggctgaggtgggtggtgtcacaggccctcagagcctgcatctgtgctgtcacctgcgtatgctgccaccaggtgggtgctgaagccatcctcgtagcagcatagtaggtgcctcctgcacagagagatagatatgcctaccacatgccaggcacgctgattttggttctttaatcttttttttggagaccgtcttgctttgtcgcccgggctggagtgcagtagcgcgatctcggctcactgcaagctccgcctcacgggttcacgccattctcctgcctcagcctcccgagtagctgggactacaggtatccgccacctcgcctggctaattttttttttttttttttttttttgtatttttagtagagacagggtttcaccgtgttagccaggatggtcttgatctcctgacctcaagatccacccacctcggcctcccaaagtgctgggattacaggcgtgagccaccgcgcccggctggttctttaatctttaaaaacccacaaggcagttcccgtgttctaggtgacgacaccattgctaaactttagccacaggtatgttcctgaagtgcccgtgacactaagcatctcaagatgtggcccctggaccggctggtcagcgtcgtccccaccccacccctgctgagccgaaactccaaggcagggcccagggggccccctttccccaagcctccaggtgctctggtactcaaatttgagaatcactgctggaagacccgggagtctcgcaaacatttctttttatttcttaaataaaaacccccgttattaactgaagcggcagctctctggcagcttcctgcaagcagctggttgatcctctgaggctgcactgtcagttgcagctcagtttcacccggtgtggctggactgtctgcttctgagccccagaccctgtcgctccctgctgctcccctgtgaatgccctcgtgctcccagagagaaactgaggcagcaacagcaggtagctgtgcgcagaccccgctgggccccagtttgaataaaccaaatgtcttttacaaaataggacagttgggaagcttgaagcttgagtggccgttttgtgagtttaaggagtggccacatttgcgagcatgctgacaaagtgctggggaatgacagggtggctgagatccaactctgaataacagggttggggaggaaggggagtagacctcaaaccaggctggccacagactcctgggagctgcgtacaggattcttcacacgattctgctggtgcatttctttgacaatttccaaaagtttttatttttgaaaaaaggagactgggtgtggtggctcatgcctgaggccaagatgggaggatcgcttgagcccagcctgggcaacacagggaaaccctgtctctacaaatgattaaaaaataaaaaaaggagagatgccccaggccagtggccagcactggtagctggcaggacccagcctgtcacccagggtgctggcatggcacatgtaggctgaatgcagtccggggcctggcccctgcctggaagccctgggcctgcagagacacgggccctgcagaggaatgctgggccagctgtgggcggggggctggccatggatggggtggggacagtgggggcgacaggcacaatagacattctgggtgccaggcaacggggaagcagacgcttcttggcggggaaaccctgaggggcccaggccacacctgtccctcagcaatgtggcgtgcacccccaccctcaggccattgaggctcactggctgcctggcccctcagggtgaagggcagccaccctcctggtggggcttcaacactccctgatgccagcccccacccaactgaggacctggtcggagggtgcctcgatggctcctgcagccccgagctctggcctgctcacctcttcgtggcctctgtctcggggccgccggcactccccgcctctcctgcctctgactgtgcctgcctggctggtgcccccaggtgtaggcaggccctcatggggttcagaacagggcttggagttctggtggagcctccatcccctgccacccctctcctggccccagactcagtagcccccagccctgccagccaggctctgccagagccacagggcccctgtggctgtccctgtccagtggctcccttcaggctccacatcctccccctccgtggatggccctgctaaggagctctgggcccagctggtggccaggaggagggaggctaggaggtcgccgtgcccggtggccttccccacctcacagacggttcttgagcttctgggcacagcggccagccctcgccctcccccaacacacgccctccgtccctctgcctcagcccctgcctcttgccccagccctgagggtagaggtcggaccccagctgctgtctgcagtggcacccagggtcccggctaaagcacacattccgtgtgggccaagagtgtacacagttcctttccgtcctgggtgagccaggcgtacagtaggcgctccgtgaacacacagtggaacccgccgggcagtgccgccaccctccggtggtctcagcccccgctgctctgtttgcatggcttttgccactctggtctctgccacccgttcctcgctggcctcactgggccctttgccccacaccaggaggtatccagtgccctccatggggagggacgcctcctttgtgctctgcctggggaaggcagggaggctggggcaggggcgggtcccagccctaccaccctgggcggggctttggccaaaggccttgccctctctgagcctcagtcccctgcccgtcccaggggtaccctcaggagctcccgaactgggctcgtgggagtctccttgaggctggcattggaagtgcccaggagtgccccaggcctgccagcccctcattccaccgcgtgcacggcagggaggcatggttttagcagctggtccacacgtctggatggttgccccagagcccccatcaccagggtcacactgcccaggcagctcctaacacctcaggttcctcaccccttcctgcagctgccgtccccacccccagaagcctgcctgcctctcctggggacccgggcggacagctggacacagcccctccccctctggaggggctgcccctcaacaggtgttgccacttgatcaggagcaaagtcagggttggggttgctcctgctgctcccccgctctgtgccccgcctgggatggaagcccaggctcctccaaggctgagctggggcccctcagcgtctctcctggggacaaagaggcagctgccagcagggcggggcagggagggcggcctttgtgtgcgccaggcccctcctggtgacctcaccaccggccggagaagggccctttcttcccaaaggcagccgttgggaatccgcctggggacaaagccgctgccaggcaggggaccagcgagtggctggctcccctcgtagcataaattagggggggccgaggtgggggaggggacggcaactactctgaccctgggagagggtcacttggtgcaaacagataaccaagcccccaacttacacatggggtgcatggggccgccccttcaagcttcattcgttcattcagcccattccttcattctgcagatggctgctgggcgctggcccaggcaggccctgtgagggccctggggacacagaggggatgcatctgatgggtgagggagcagtgggtgaggggcgggggtgcccagtctggagggggaactaggacagacgagtcagagctgcccagaagccccagggcctgggttggggcaggcgggaagatccctgctgagcatggtcacctagcaggtcacccagcagggcagcggccacagccgccaagcccaagtgcacgcagcaggccaccccaggcctccaggagagctcaggaaaatatctgattttcaatgcgtggtgttgagtgacacccaccccccatgtgtggccaagggcttcccgtccccagggtccaggtgacccacaaagcgtcctcacagccttgttggccctcggcctggcttcctggccccccgcaggacactgttccccccccaccacctccctgtaccctgtcttgaggcctagggcctagtggcccagggtggccaatgcagagagcagtgtggccagcacagagagacaggtggcctgagagtcccacagatgtccactgctactcaggcccagctcccaaggcctgttcctctgcctcccaggcactgggcacgtgctccatccccaaggcgctgagcacatcaggccagaccacgtgggcttcctgcaggaggaggcagcaggcccaggtcaggctgggtccgggaggcaggcacggggtgtgctggtcagcagggctcactgccaggcccagaggtgtcctggccatgcggatgacagaaggccaagtgcgtagggcagagggtgtgaagggcctcgtcctgtgagcagggcatgcgagcagctcctggcctgacctccagccccgacacctgaggcctgagcttgccttgcagtcatcagcagagccaagactcccagatttccggggctgggaaaccgtcaatgccttacagagccactaggtccacagctgcccagggcggggggcacctgctgggtgctggacctccctgcaccccgtctttacctccgtgtgtggatgggcaggagtgtctgcaggcctggcccaggccaggaggaggcctgaggcttctggggcaccgagcgaccacaggccggggtgcgtggctcccccaggagctccagaggccctatgccccctcccccaggagccccagaggccctatgccccctcccctgcagcgaagcgagatgggcgggggcgggtgtaagtaggacagcgctttgtgcgcgttgctatggcgccgccgccgcccgtgcaggcttcctctgggcgcgttcccaggacgcagagcctgccagttggccctcccagcccctggcagggccccatcccagtcggggggcctcagagctttctccacccacaggctgctggggggcagactaattgtcccacttcgttacaccctcaaacccgcagcacacatgtgctcacagccacgcagcacacacgtgctcacagccacgcagcacacacacacacacaggaatgtgcacatgctcacacatacatgtacacatgccacacacatgcatacaccccacagccacaggcaggcgctcagtccttagcgtgccctggggctgcagcctccaggttcacacccaggccccaggggccccaggccagtgcgcggcctccgagcagagcacacgtggtggtgggcatgaacgtgcaaggccaggggctgccccatctcagccacctgctgagactgagaggtcattgctgaccttgaggaggaggctgggggcctagaattcagaggacaagccaacctgaaccctactccccaccgctgggcctgtgggacagactcaaggccctgtgctgggaggactgggacttctgatgccggcgagctgaggctgggcccttcctgctgggccagcgcctcgccggccactggataccaagcgccccattggatgctcacagccccacagtggggtgagcaccaccagccctacacgcaggacaaagtggcctagagatggcacggagggggccgggcagcgacgctttgccggggtgtggcaggagggtatctgtctcttgaggcacaagaggccttgggtggcccagcctggctcctgttgtcagctgatgtcacagggtggagaacctgggtgtccggggagacagatggccccgggttccctggctgccctgaaacctgctgatgacgaccccaccaaggggcgggacggcttccttgcacttggcgtcctggagaggtgacgggctataggctgcagggtgggaatgcagggaacacccaggccctctctgaagaccacagctgggccctctgacccatgcctcagcctccagcccaatggcacagagctggccgaggtccttgccccacgcgtgccgccaccggctcctgaggggccggtggacagggacccggcggtccctttaccaacaggaggcccatggctcttggcactgccgcagaggctgtggcttcctcaggagcacatctgtcctttggggtaaacgctgctgcctcttagaatctgaggcccctgggacaggctggagctgaggctgacaggcagggccctcgtcacaaagccgctgagtccccccgaagccctcctgagcgcggcgctgtatgagaggtacccagaggtgctctcagaaggcagggctgggtttggggcagggcaggagtgggtaccgagaggccccaaacagcttcctgagggagagggggcttcacagaggcagctgcctcagtgaccctgtggcaggtgtgtctgctggcaccgaggtcttttagggcaatgaaggagaaagggcaagacagggagaactcgggggcataaaggccagggcgcgggggcctggcttgttcctgcagctgcagcgacatgcgccaaggctcgctgtgggcagaggtctccgccaccaagaagcgaggctggagggcaggcactgattctccatcaccacacccagagcccccactgggaccagcgaagcacaaggcagccagtgccacagccccacaccccgcccgccagctgccctgtgtggtgtggaggcggctccgggggcggctgttcacagcagtgacccccgcctgctgcacggccacttgagctgtcctggctgctgccaacgccactgtgaagtatggtgaccccattggccagggatggggtcagcacccacggacgtggtcggggaggtcaccaaagccttcttgccggaagtggcatttggcttggggtgtggaagaggagcacaaattacccaggagggccgggccagggtccaaggaagggccacctgtgcagagacgcagggctgatggcacaggccttgcccacaggccctgccacggggaaggacaagcccctgccagccggctgtgagccaccaccatcctgatgacagacccacaccggcaggcagggcaggctgcctgtggcagagttaggggggttggggggcgtaggttagagactgccagatctgctggggatccgtaccaacccatgatggtagcaggtggtcactggatgccccgcgcaagcgccatccacccccagaacagaagcgcagctcaggcgatgccatggccacctgtccaccattggccagggcaggtgcacctggcgtggcccaggcaggaccacttctggtgttctgggctcggcaaaacctggccttgggcgccacctggtgaccagacatgggagaaccaagcaggcaagtgggggcctggaggggcaggtgcgtggcgtttgggggacctccaaggtcagggagccacgtgctgtgcaggtgagccaccctgcaggccaggggctgtgtggagggcggcaggtagcagggtctgtctggagtcctccctccacccagcctggccagtgcggatgctgagctgtgtggggcccatgtgcactgggactggttgagggaacaggccagccatggtccccactgcagcagggacaggcctcgcacgttcagctagaggcaccccctggggcgggctatcgggtctgccctggcacagacctactgccggtgtggggtccatggcagtcactgggccagacttggtgggctgctgtggggcaggccttggggggctccccaaagagaacccaacccaggggaagcctgggactggtgctgtgctctctgtgggagccactgatctccaggatgcagtcctgcccctgtaggggcccgctgccccaaggctctgtgggatctggccctgcagactctcacctgcctgccaggctccaacctgggggtccttgctccagccgtccagcctgcacactcttccccaggcccccatggcctgctccacaggaccacctgcatagccacattggtgctgggatgcctgcttttcctttcaggggctgggtcaggattaagggctggaagatgccctttccggggagatgaaaccaggatgcaagaggaaggggcacacacgcccaggagccccaggctgccaagagcaccctgggcctgctgtggccatctgcaggcaatgcccagaccagaccacagctcaagaaggcagctgggcgcctcgctgccccacgcctgcaccctgacatccccagcacgttttttaattttttttttccattttttattttttgcgtgtgatagtcttgctctgtcgcccgggctggagtgcagtggcacgatctcggctcactgcaacctctgcctcctgagttcaagcaattctcatgcttcagcctcccgagcagctgggactacaggcgcccgccaccacgcccagctaatttttgtaccccagcacctttaataagcagctatcggcgaggcccagtgggttctgctgcccatgcttctgtgaccccgcccccatggctcacccctcctcctgccagccaggccagaaccctgggtgcccgcatcccctggtgccgtcctcactgcccccaaatcctttcccacccccctcccccaaccccactgctgcccccaggggcactcagcaaagcctccaaacctcccttggcttgtggggcccaggaagccctggcagtcctggcgctgtcccctacccgctgcctgaagttcttccagggcctccagtgtgcccggccctggctctgggctctgcttttgaaaagtcttcattttcctttacatccccacgtgcagagaaatgccggctgcgcccgaggagcagagttggaggggcccccgggagaatctgaacatcccagtttcctgatctctttctgggtctcactttcatctctggccatcagcaagggcatgcccctccacccgaaggccctgcctctgtgccaggctccaggtaaagggtacacccagcggggccctgactcccccaacatgggtgatcctggtggcacacgcacagagctcatgtacacccagccacgcctgagggtgccggttcctgctgaccccccgtgccccacaagacaggtgcccacagagctttgcagcatgttccccgactcaggaggcaaaaccgtccccctgggctctgctcctgctgcccccggggcccacgccacctgcagagtgcacccacaggtgtcagcgtgttgagccaggtgctgctctaggtactggggatacaagcaggaacggaacaagtttggcgtcttcagggtctcaggtggcggggcccctggcatcgtgctaagccctctgaggacgatgaggcagggtggggcagagcgcaggcactgtggttggagactgactgcagctgacatctggcacgtggtgcccgctggggtccacgtggcccactgggctctctggcttctctgaagccaggcgtggctgctggtggtcagaggatggcttggtcatgccagagctgggacacagcacagaagccagtccttcctgtgggaatggccatcaggtggcctggccatgaggctgtttctgcccgtgacccagcaccagacagcggccgttccactctcaccctctctgggtgactggtacacccagagacagcagaagggagagggacctcaaggaacccggctggccctccgcatccatttctgtccctgtgagcagagccctggtgcctctctaggcccagcctgcccaacctgggaagggctggcctgggacccagaggcgggaagatggctctgtcctggctcccagccacactgagcctcgggcaccatgcccttctgtcagcctgcagatgcttgctgggcaccctccctgccccaggcctggcaggaaaatgaggtgacagaggcggccctggggagctccttctgctcacctggccacccctcacctaggccagagccagatcccggccccgcctgaccttgccccgcagcggcctctgcaggcgcagggcctccgagctgccaggacacggcttctggtcttcttcctccctcctggtccacgcagcagtcctgggtgccccaccccacacggctatggccctctgtgggtctgcccttcccagccctcaccagtctgtgaaagcactggggatgcggcgagttcacgtgcccgtggggaaggggccaggaaagacaccaaagtggtaaaccgcaggaacatgaagctgtgagggctggtgacgccgggcgggaagccaggtggggaggcaggctggtgcgtggcctgaccccacctcgcagccgggaaactgaggcacacagagatgtcttgcacatgtcagggccccaggtaggtggtggcaggagtctgggaccttgggtgggcctcaccagtcacacagccttggctgacctgtctgtcctcccatccagccagagggacacaaagacctctttgtctctccacccttccgcccagagcctccccagccagtgcagctctgagcgtgtcccccagggagggagacagcccctggtggggactggcagtcctggcagctgccctgaggcacaggccctgggggactcggtgctttgagggcaggggcaggtgatggagatcggctggggaaagggaggccgagaaggcggcagtgtggagcgtgtgaatttgttcatgaacttagctacaaaaatgtcttttccagtgtcacagctcttctagaatttgactagcaggttttccgatttttactggaaagccctttaaataaagaaagaaaaagaaaaaaaaacgtcttcctcaatcaaatccgaggtggttccttcccccaccaggctggctgggtggggagagaaggcttgaagcccaggctcctagggagaggctctgctccccaccccagggctgggctgggacaccggcccttcctggcaggggtgtcctactccacagaggagccttgggaggtggccaccactgggccactgcccctcaccaggcccagaggcccagttctcagcctgaaaagaaaacctgccctgggcccctcatgaccagggtgaggcttgttgggcacagagggcctgtcgggagcactggaacccagcggcctgggaggggcccaggtctgacgcctcatcctgcaccaggctcgctgcaggccttcagctccagaactgtgttctcaaaatcctgttgatgctgccacaagtgggctctctcctcccccattccgggaaggttctgggtgagtggctagccatccctcccactgggagctccagtatctgaactgccagccacctgcagccgccacctcaccccaggcggtgctgcaccctgggctggtgggaccagcctggagggccctcctggggctctggggctcatggacagcctcccacagagtgtctcggctggtctcatttctgtctgggagggagttgggtgagcaccagggagaggctgagtggatgcccgcccacctggaacagtgctaggtggggatggggggggggcatcacggggcacacacaagctgtcggaagggccgatgtccacaagggacgagagtcaggggcgcggctgtgggggtggaggcggcctggaagagcaggcatggcacagcggccgctggctcatgtggactggcgaggcactgtcctgctggggccgtcccaaagggaagcatggcccgtcactccccaggctaaaaaccatccacggctgcccctcctcatggctgaagtgcagctcctaggccctaccccgacgctctcaggtccccttctctccctcaccctgtggagagcggacctgcctcctgtccctcggaggactctcaggccccagccctgccgcagcagctcgtggtccagcttggctggccctgcctggccctcccggctccagcagcagtggtggctgccagcactctcactctgatgaagctcccagcccgccgactggaacagtgtgttcaccactacggtcttgcctgggaagagacgaactcctgcacttcctgtcacgttccacttcttgtccgtgaccagctaacctcccacctccgccaggaagcctccctgggcttctcaaccaccccatcacatccggccaatgcttcttgcgatggatccctcagaaagccacgtgacctctgcaggggcccttgccccaggtccacgcctttgcccccagcacctcacaggtactcggcagatgctagttaaatggagactccaccccaaggctcagctaccctccctcagtcctcctcaccccatgggttagtgggtttccttcaagtacctcacccagcagccaggaagattcctcttcatgtcaaatcggtctgaagggcacactaggcacgcggtggccctgacactgcccctccctggtcctttccaacagcaccgaggacatggaggtcggcccaggctcaggaatcacagagctaactgctcatttcggcatcacaagcacgagcagacgaatttcagagacagaagccaacatccccacccctcatcttcagaggctccagcctgcctggcctctgtggctgggtggccagccaagggctctggaattggagaggccttgcttctctacagcagggtgtgacccgctctggcctgctggccctcctgccccagggaccgagtaggaggcacttttgattccacccgggctctcagggggatgaggtggcctcaggtgagagatcctgattggccaccccagagccccggtggaaggtgcagcagagagaaggtcctttggatccgataagcagaaggattttaaacactctctgaagctgtctgaagatctgagatttttccactcatttattcagcaagtattcgccgaatgcctattacatgccaggagctaaggacactatttccaaagaacagctcatccaaaaggcatgtgagtgcccattactgccaggacctgaggctgcatggatgaagagacagatcttgccttgaaaggcactgtggcctggcatgggagagacaggtgagccactgtgttaggagagctattaatagggtacaggaacagaagaaacgctccacggcccaagggatgggcagggagggcttcggatgagagcaccagaacccagggccatgaacagcaaagtcatctgatgaccttactctccgctcagcactcagaaccacccagctccatgtcccaacacccacagaggactgaggtggggcagacaccagtgtgagatggagacagaaggtggggaactggcaacattcatctgaaaatgcagccacagggaaacggctcgagactgaaagggttctaacacacactgaaaacctaccattcgctgtgaccgcagcggggaccagagatggagaggcagtgtgcggcactgagtccttaccaaatggggtcacagacccctggcagctccggaaagaccaaagaatccgaagcggggaaatagcttcacttcacttcaaccttactatagaaagatacatttttgcagttgtaattcacaagtggaagacgtacggacagaataaagcactcgtttaagacagtctttccacgatgagggatgccggttcactgacacagtgactttgagacataatactggagctgaatgtttcacattaaccagctgaatcctttaaacctaagtgctaagtactgcccacctttcagaagaaactgaagctcaagggctcagctttgaaagtggcacagctcgccggtcacggtggctcacacctgtaatcctggcactttgggaggctgaggtgggcagataacgaggtcaagagatggagaccctcctggcaacatggtgaaaccgtgtctccactaaaaatagaaaaatcagctgggcgtggtggcgcacgcctgtagtgccagctacttgggaggccgaggcaggagaattgcttgaacccaagaggcagaggttgcagtgagccgagattgtgccattgcactccagcttgggcgacagaaaaaaaaaaagagagagaaagtggcacagctgagatgtgaacctagcagtctgggccccagcctgcttttagccacttggccagcattccctgaggtgggagctttcagaaatcctgatgtccagactgtaccctatcccgatgaaaccagaatcgctggggtgggccccaagcaccagccatttcttcaactctccaggtaagtccatgactcatgaactgtaaccaaattgtccttccctcctttgccaagtgactctgggcagttccctgggcaagggaccacctgaatctcagaatcacctatgaaacagatagtatgaaaaacctgcctcaaggggtgctgagagcttaaaatgtacatagaacattttgcacagatggctgggcagtggagatggggctgctggggcagcctggaccacaccactcagggcctcgcagggacgtggctgggtgaaatagtggaggccactgaaggttttcattcagaaaagccatatgagcagagccgtgcttttagaaagaccaagagggcaaataggtgaaatagcctgaaatagcctgctggtgactggcataaaaaaagggcacaagctgaagagacctagaactagggacacagagtcctaaggctgcctggtgacccccacccccaccccaaaatctgtgcaatgataactacacaaaatggaaaagcaaggccaagtgcagtagctcatgtctgtcatcccagcactttgggaggctgaggcaggaggatcgcttgagcccaggagttcgagaccagcctgggcaacatattaagaccctgtttcaataaaaaaacaaaagaacccaaaacattttgtaagatgccctcagacatgtcctgaccagcaggggcgaccccagacctgcatataagaggccttcaattagggctcagcttgtacccagaatcaagagccaagcttgccagggcactgcccctcagcccctgccacctcgttccagctcagcccactccagggtttcttctttaaaaaaaaaaaattatattgatttttttgtagagatggggtctgtgttgcccaggctggtcttgaactcctgggctcaagcagtcctctcaccttagcctcccaaagtgccatgattcccggtgccacacccaccgtctcctgtcctacttctaaccagccttgaagggccagtgagacccctccctaagccactggtctttttccggcttgcacttgacacctgacctgacaccagacattcacacctgagacagaccaggcgcagctgactcccctcatcccttctctgactaaactggaatttctccatggccactggtggcatgatggattcttcaatcctcagcgcaacacgaggatacactaggagcctggttaatgctgttgccagtataagtgataagaatcctcacgtgtggccaaggatttattcaaaagctcacatttcccccagagtgtttctcttcaacctatacacatcgttgttcttggctctgggcctatcatgcgtttgcaaggcttgcaaaggctgcccctgtttggatcacctggaagataaaagcaggcagagaagacaacaaaaatacaatggaaggccgggcgcggtggctcacgcctgtaatcccagcactttgggaagctgaggcaggtggatcacgaggtcaggagatcaagaccacagtgaaaccccgtctctactaaaaatacaaaaaattagccgggcatggtggcgggcgcctgtagtcccagctactcgggaggctgaggcaggagaatggcgtgaacccgggaggcggagcttgcagtgagccgagatcgcgccactgcactccagcctgggtgacagagagagactccgcctcaaacaaacaaacaaacaaaacgctccccccaaaaaaacaaaaaacaaaaaacaaaacaaaaaatacaataggaaagggctaaaaataggaaaacttattgctgtcacatagcggacttaaaatagacaaacaactgcccgaagtgagccaggcacgtctgcagtccaagcacacgggcttcactagacttagggctgggagagggccggaggccggagtcagaacacctcacacagccgggaagggccgaatagacagaaagactcccacacctccgtcacaaagcagtgaagacggtttcatagcacactatcacaactctcctctggagagtggatctttcaagaactgtctcagaggttcttctttctaaaaataaagtcaattcttatttgagacccaggcatcctcctgagggagcagagcatgaggcccccacccccatcacacacatacttcctaggctgtctcaacaagagcacagtgacctggtcacctgggcctgggtcctggcccacacacaaccaccctcacctccttacagcatggccaccaactgcagccaaggaggccacctgcccccaggcctgcctgctgtgggctccattaaggaaggactcctcagctgggcacggtggctcacacctgtgtcccaacactttgggaggctgaggcgggtggatcacctgaggtcaggagttcgagaccatcctggccaacatggtgaaaccctgtctctactaaaaatacaaaaaattagccaggcgttgtggcaggcacctgtaatcccagctactcgggaggttgaggcaggagaattgcttgaacctgggaggcggaggttgcagtgagccgagatcgcgctattgcactccagcctgggtgacagagccagactccgtctcaaaaaaaaaaaaaaaaagggctccgcacccaggtcagacagttcatgaaggtgataatatatagagaacacacacctcagactcacagcctttctccactgcaagcgtaagagactggttttatttcaagaataactaagggtatattaacacatgtatctcaaagtaacattgaattattgaagacatactgttccaatactcaaacagttcacagagaggggacaggaaccaatgtactggaaaaacacacttgtattatatgtaaaaatcgatggccaatatttctcttattaagagaaaaatacccaacaaattaaaaggtgaaaagctgtgctcaaaaaaaaaataaaaaaacccaaaaccttgcatgcacaagctaagctcagacccttaaaaaccagatagaaattgacaaagtcaaacaaaggagaaaaactagctgaacttctcaaactaaattatatcaaatatatgtgcattttagcaaaataaaccactaaactatactttgtagacatattcattacatttattttaataactacttcattataggctgactggctttcctgtgtggataaagtgtgatctgaaagcaacgctgactgaatgtaaataaagcaaacgttcccagccatttttggcatgaacatggactacagcgtttaatgcagacccaaagccacacatttttggggagtaggttttacttgcagtacagattcttttcattacagatcacaaaaatacaatacaatgtgacaagcccagtttaagaattacatgcagtagctcatattaacacaaacagctccccacgaaggccgacaagagctaaatccggtgtcaacagggttcattgcaggagtagaataatccggtacaaggaacgagaacagattgaaaccagaaacaaagccatgcctgacagtcaatcaaggtcaatctgatcatttccatgaccaattacccatgtgaacaattcaaaatgacggtggaagagctgagcaccctgtactcacacacgatgcccacagcttggcaaaaggtacacaaacacttgtttgaaaagaatgactgaaacgtctactttcaaagaacaatggacacttttaaagggaatgctgacatttaactttacaaaatgaaatttaaaatgtaagtagtactctggggaagaatatgcctgaagcgtaaccatgatttcccagtggtataattaaacagagctctaatttaaaaactcttcctgggctgggcgccgtggctcacacccgttaatcccagcactttggggggccgaggcgggcggatcacgaggtcaggagttcgagaccagcctgaccatcatggtgaaatctcaactctattaaaaatacaaaaattagccaggcatggtgccacatgcctgtactcccagctactcaggtggctgaggcaggagaatcgcttgaacctgggaggtggaggttgcagtgagctgagatggcaccactgcactgcagcctgggcaacagagactccatctcaaaaataaataaaaaataaaaactcttcctcaagattttaagagcattctaaaattatgatacagaaaagcaatcctacaactactgtggccaaaacgtggattccaatgacctgccttgagcccgcggttgccaggagttggacctgcagtagtatgggaagctcacggcctaaataccgactgccctctgaccccaccgtccagcgattctagaacatttctagtaggaaagacatagcaagggattttcatgattgggaaatactgagagacaagctgaagatttgttaagggctatgcttctgtcatcttttaggtatttaaggctactcctttagctagctactttgagctgtttaaagtgactatctccctacacagagttacacaatgagcatctctgaaagagaatattaccctggatttccaaagatgtactctaacaggatgaccaggcaaaaggtgacccgggggaggagtctgttataacactcggacccacatgttctcaaggcacttcagaactttgggaaatcattttgtaccggatcctcagaaagcatttatggaaatacacatcctttagaagagagatgcttcacgcacgactgactttaatggctctttcaggcaacagagaaaccaccacatgcccatgacatgagctcagttgttcagcaggcacccagaggaagcctttaattccgagcaggtttcactgattggtcctggagcaggtgtagttatgacatttactaagtgagtggttaacagctgactgcctagaaaacctaggaaggcctggtccctctgggttactgacagcgtctaccctcacgttgtaaaacagcaccggggaggtgtgacaaggctgtccattttacagccttggacaacagaagagaaccattatgtgctacattcagactttctgatttagttttagtataacctgacattggtaacccgtctccagtattcatcctccaactacaggtatgagtgtttcctttttttttttttaaaggcccattaacttaatttaaatgttcccatccttatgaatttactcactaaggaaaactataagctcagattttacaaacaaaagcaacttacaaggtattattgctggtcctttatcccttctctttaatgcaatctcaaaggttttttggctattagttttcataattttcttatgttgcacacaaaaacaagattcctctctaaaacgtagaggatggggaaaatgcagatgctgtttttccaactaaaaatgtttacaaaagaacagactgtctgaacaaacaaaaaaaccccaccccgttaagctgggtaggaccaatcaggccttataagtgaaaaaaaagccttctatcgagcataatgaaacagaacatgtactgcttgtgtttgaaccttactcttatttaaccaaaaatttcccctttctcataattttcctagtattatgtaaggttatgcctagttctagattctgaaagacctgcattttaatgcttgcacaacccatttaaaatctacaaaagctgcctctattttgttttctgattaaaaacgcaaaaaaaaggacaaaccaaacaaaccacaccacatcatacagataatgatccgaatggaaaagttaacgtgctgtaatgatatttgtcttgcaacatcaaaagcagcagatactgaatagaatttgcttcaatcataaatactgagactgaaatatgcacgtataaatcaatgaactgaaagctctctatacatagaagcacatatgaagtgcaaaacagtatcaaaagtgagatctctggtatttcagtactcccattcatcagatttcaggtcgagatagctgagaatattctgcgcaagcctcacagcttgtttcctggcagccttacacttctcttctccctgcggatcaacagcatccagggctagcagctgcttggtgagcagctcttccagccggatgtagttcttatcggttcgatttccatcaaatgaaagaacttctccctggatctcagacaagtttccaaggacgttccagacggctttatgggatgggtgctcctcacaagcaaacagctttcttttctcaagggcctccttcaagtcaatatatgtgatcagagtttgcacctcgatcactgctcttctcctggcttcccggatgcaggggtttttttcaagacttacctcatccaactgtccaattaaaccctgcaattctgttttggagctcaggtacaattcagaagggttttgtgcttggagaagttcattttttatttctctcattctcttgaggaccttttctatttttaaaatggaatgattctgtctcaggtcaaatgctttagttgtgtctgcttcctcttccaaatccagatatttcaataatttgttgatatcttctactacctccctccgataatttctgatttctgtccggccgcacacatctagagcatccaggtcagcgatcagccccgagagcacacaggataagtgcctgcaggtctcattgttgttcacacccatcagaagtgcaatcaggacccctcgggccttgttcacctcacacatcacgaagttgattttggcaacggaaggatgtgcatcctcggaaagcggcagggaaggctgctttttcatgcagtcttcgattatctcttgcaccgcacagattttggttaaagtgtgataccttgctttccgcaaggagatttttcctccagttttaacatgtgtcagcctcagaatgatatcttggatgccttcttcaaactcatcagttacgcagttgcctccattataaaatggcacaattttctctctcacgagggactgggcttcctcaaaaatgttctgtatttcaatccggtgtgggtggtttgcattctgctccaactctttgagaagacgttctgtctcctgtgctgcccgcttcctagcttgctgaatatctccttttccttcagtatctacagagtctatttcaaaaagctgttttgttagaatcctctccagtttcttgtaattcttgtcatctgacagaccactgaagccgataacttgctgttctacactttttacttccttttggatttcctgaagcctactaatagaaggatgttggtttcccatatccatacttttgttgtgttcagtttcacaagcactaaaagacgacaagaatgataacttactacagcacaaggcttctgcagaacactaatggtatattaagtcattctaaaattctcattttaaaaaggtatacttctgagcagtcatcccacctcagcctccccagtagctgggtctacagtcgtacaccactacgcccagctaatgttatttttagtagagacaggtctcactatattgcccaggctggtctcagacgatccgcccgcctccgcctcccaaagtgctgggattaaggtgtgagtcaccgtacgcgacacaaactatttggaaccagcagggcacctttatgaaaggtgaaacagtagctcttgtaaccttccgaacactaacagtaccccgccccgccacacagctatgcctagtttccagaaactctaagcaaaagaaagaaccagaacaaaaaccagtggctctcagacatccccaaggtccccgcttcttcgtttctctccatccctttgtgcacttcccctccccacccttttagctcctcacacatcttccctcacagaagtctccctgaagagattaaaaccccacaggtaaagaagagcgaccgggacagcgctgaagggcaccaccttgggctttcgaggcccaacacctcctcagcccccaacatgctccactctctcaaaaaaaaacaacccgcgaaaacgtggtaactatgaataattcattcactcgcctcccactgggagtccacaatggcctaatgcacgtttcaagctcttggtttctatcaaacggctcgctcaaggtgggtaaccaatggaaacgcataatctatccccggcggatgtcctggaggccacggagggaaggcggcccgagctgcttcctccccgcctcgcccttccctcttggccctttacccaaaagaagtctgaattggatgcggtcttggcgtcccgtggctgaggtggcgaggtggaagatcagccctttacggggtgcggcaccggagctgggcccccagctgcatgcctcgcacccctcccgactaggtctgagcggggcagccggtgaaggggccgctactggctgcagcagccgctccgggcgtcttggcccgggtgccagggcgcgcctgcaggacgtgacctcacaatgggcgcgcgaggggagctcggcccggccgggggaagccgggggaggaggggaaccgaggcccggccggagacaccagagaccaggcccggccagccccggtcgcttccgaccccaggggcggggacagcgccgagaccgactctgccctgcctgatccgacaggccgcacggggctgggcgctggcgaaggggtggcccagcggggagccccgcgcggaggtggtgccccactcgtccccccgagagagggaaaaggctacaagccgcgcttcgctcacctgtcccgcccgcgccatcgcgcgatgcgtcgccgacgcttccacgacttccgcagctccggcagtcgcccgggcccggcagccccgcccctggccgaacacccctaaacccggggacacctcctccggcgtccgcgcctagccgccggcagcgccacgcccaccgccagcggcgcagcgaggcagcctggagtgaccgcgaccaaggagcggccgcccgggtcagcccgcgccgcccgccgccccctcaccccgtcgcaccgctgggaaagcgcacggtcggccgcgccgccgcgcttcctcgggcttcgcgaccctgccgtaaagcggcccctcgcgccgtcgcaatgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtaagcaggggcctggggacattgggccgggaggggtgaccggaagggaagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggcaagtttgtacctaccttatttgttcccgagaatgattattttttatttttaaagagctcttggcttaccgtgcgttttttttcgttgtgtgtgtgtgtgttttggctttgttacaattattagtgcttttcttcaagcggcgagcactttatcatcgtacttttgtagcacttcacgttgaatagttgttatttgcaaactatgtgtgggtatatgcatgttactggccaaagatccgcaaagaatgtctgtagcaagaatgtctgtggcaagcaatttttataagtggtacttttgggagggatgttttgtttaagggaggcctaggccttgattccgtctgtcagatgaaaatgttgactaacggtgtggaatgggctggagataaaatattcaagcaaagcatgcaaataccaaacaggctaatgaaggaggctggaaaacttggtttaaacaataattaaagaagtattaaaaaagtgttaattaaaaattggacgggctccgtggctcacgcttgtaatcccagcactttgggaggccgaggcaagcggatcacgaaatcaagaggtgagaccatcctgcccaacatggtgaaacgtctctgctaaaaatacagaaattagctgggcatagtggcgcgcgcctgtagacccagctactcgggaggatgaggcaggaaaatcgcttgaacccgggagacggaggttgctgtgagtcgagatcgcgccactgcactccagcctggcgacagagggagacttcatctcaaaaaaaaaaaagctaattaaaaattgcaaatgtacttgcttgtacattttcatttctgttgggctgtggctgttagtacactttcataattgtagctttgaaggtctatctagtttacaatttaaacaaggagttaccagggcaacttgccaaccagacacccaagtggctagctcagttctgtgttacagtgaccaagtccttgccttctatccctagaacatagaaacccacccagcatctctatctttgggcagaaagatagagcaggtgtctgaaaatgctctaagagagcaaacgggaaatcaaccaagacatttcccgggcgggggggattttccctagcttattttgtgaacttgtgctggaaagaaacaacagcacccaaataaggatttctctattgtcatatacacttcttttttttttttttttttttttttttgagttggagtctccctctgtcgcccaggtgggagtacagtggcgtgatctcagctcactgcaacctctgcctcccgggctcaagcgattctcgtgcctcagccttccgagtagctgggactacaggggcccaccaccatgcccggctaatttttttgtatttttagtagagacagggtttcacctgttggccaggctggtttcaaactcctgacctcaagtgatgcgcctgcctgggcctcccaaagtgctaggattacaagtgtgagccaccactctcagccttagacttcttgttaaagtaaaataaatcttaccatgggtctgttctcaagatgagagacctctctgccttgttcgttttttcttttttcgagatggagtttttgctctgttgcccaggctggagtgcaatggcgcagtctcggctcactgcaacctttgcctactgggttcaagcaattctcctgccgcagcctcctgagtatagctgggatcacaggcgcatgctgccacgcctggttaatttttttttctttttttagtagagatggggtttcactatgctggccaggcaggtctcgaactcctgacttcaggtgatccacccgccttggcctcccaaagtgctgagattataagtgtgagccaccatgcccagccagcaccagcttttaattgaaaaatattatagaacttaagagtcaggcaccattcttccttccaaatccatctttaaaactcagcttttcagaaatataactgcttttggtaaagaaaaaaaaattaagacttttaaattctgttccctagccacttcatgcctgcttatgtcttacctatgtagtttgcatcattggttcctaaacttgtttgcacgtaagaattagtctgactcttttagttctttttttttctttaatccggaagttcctgaaccagaataggttcagagatactcccttttagttctttttaatccataggttctgcctccatcacctccccacctttttttttaatttttttttttttttgagatggagtcttgctctgtcacccaggctggagtgcagtggcgtgatctcagctcactgcaacctccaccgcccgggttcaagcaattctcctgcctcagcctcctgagtagctgggattacaggtgcctaccaccatgcccggctaatttttgtattttttgtagagacgggtttcaccatgttggccagggtggtcttgaactcctgacctcaggtgatctgctcacctcagcctcccaaagtgctgggattacaggtatgagccactgtgcctggcccaaagtcacttttagcttcaaaaatgagctgtagggtatgccttcttttcctgtttccgtggattgtttactaaggtttgaatttttctgtgactggtagaacctacaagtcatttgaacctgagttttcataagaacaagccattttaaccccatcttctttttggttagagtttaaccccatcttctttctggttagagttactaaactggtaaataagagtgatccggccaggcatggtggctcacaccttgccagcactttgggagactgaggcaggcagatcacctgaggtcaggagttcaagaccagcccggccaacatggtgaaatcctgtctctacaaaaatacaaaaattagccgggcatgatggtggtacctgtaatcccagctagttgggaggctgaggcgggagaatcgcttgaacccaggaggcagaggttgcagtgagccgagatcgcgccattgcactccagcctgggcgatggaccaagactcattctcaaaaagaaaaaaaagagtgagccattgcatattgatttaaacaagacatctgataaagtctcatgtatttttgaaaaccgtgtcctgtattgtggtgcttaaaacaccaatggaaacatttgtctcagggtggttggcatttcctgcacaggttcttcatgaggtgccagagatacagaaatgaatgtgtgtgcctcttttcacacatgcacagatggctctccaggcaggagctctgcatgctaacacatgcctccctggtgcctagagcagtgcttggcctttgcatggtggtgcaggggcaggcaggttgatgcttatggagaatggctgaatccaccatgtccatctttggaatctatcagaagtttattgtttgcagctccaggcagggtctcctgaggatgcaagggagcaccaccctgggcctgcctgttgggcacctaacttctgagaggaggagggttggaacaagtccacaaataaccatatttttcccttttttggacatagggtcttgctctgttgcccaggctggagtgcagtggcacaaacatagctcaccacagcctcaacctcactggctcaagtaatcttcctgcctcagcctctttagtagctggggctacaggcatgtgccaccgcacctggctgatttttaaaatttttttggcagggcgcggtggctcgtgcctgtaatctcagcacgttggaaggccgaggcaggtggatcatctgaggtcaggaattcaagaccagcctggccaacgtggtgaaacaccgtctctactgaaaatacaaaaattagccgggcgtggtggcgcatgcctgtaatcccagctactcgggaggctgaggcaggagaattgcttgaacctggtaggcggaggctgcagtgagccaagatcgcgccactgcactccagcctgggcaacaatgcgagactctttctcaaaaaaaaaaaaaaaaaaaaatttttttttgtagctttgcacagcggcagtattgtagccaatgagatttatctgaggtgtgattattgataattgaaaacttttcccaataccctgccgtgatgacttgcaatatagtcagcactggcaatttttgacagtctctacagagactgaaaacaaaaattttttttatagagatggggtctcactttgttgcccaggctggcctcaaactcctgagctcaagcagtccacctacctcggcttcccaaggtgctgggattacaagtgtaaaccaccaagcccagcccacaaatcatctttagacaaattgtctaatcatctttagacaatactgaggtgcaggccttgtgtctgttggtggtgggaaagagatggttgactagggccttaaagataataaaaataattaacgtatgtatacagcaggggtggcttcctgctgtggtcactccagcgttgggtgaaagtgttccagcctggatagctctcccatctcgttggcattcctgaaattaggagactgttttcattgactttctagtgtttgcccttctggtggattatccttcttttatattgctggatcgggtttgcggatttgtctagcatccatgtagaatagggggctggggaccctaaccctcagtaaatatgaagttcctgactccttctcagatgggaactcaaagcctttatagaactgagagttagaacaggaagcaagaacgctaagagcttgctaacatttttctcttcattattccctggtggtttccccatggtagctttgtgtcatgtacgggcacttccaggaatagggtgcaggagaaacgtctcagtgtctccccttccgaatcttggcttctggagggagagatgctggggtgggagtgctccttggtggagtactcaggagcttagtaaaagcagagggggctggagaggcaggcctggcctgcagagccagcatggagaagcctggtgtagggctctccagcctgccaatttacagttaagaagaaaggagatatgtatatatatatatacacacacatacatacatacatacacacacacatatatacacacatatatatacacacatgtatacatatatatacacacacatacacatatacacacacatgtacacatatacacacatatatacgtgtgtgtgtatatatatatatatgtatacgtatatatatatgtgtgtgtgtatatatatatatatatatatatatagtgacagggtctcactctgtcacccaggttggagtgcagtgacacgatcttggttcactgcaacctccgcctcccaggttcaagcaattcttgtgcctcagcctcccaagtagctgggattacaggtgcacaccaccacgcccagcttattttttggtattttaagtagaggcggggtttcaccatgttggccaggctggtctcgaactcctgacctcaaatgatccacctgcttcggcttcccaaagtgctgggatgacaggcgtgagccaccgcgcccggctgaaaaaagattttcacaagaaccggaaggttaactcccctcccagacccaaagatgcagattcggcctgaccagtaggaatgcacatgtgcctctctgtgacaagggcagaactgaggctgcttctcaggagactgtgagggtctagcgtgccctccccgcagacatgagggccggatggaagagccttctgtccccagcatagccaatgggacaccatgaatcataggcttgtactgtggaaactagcaattatggtaattattcgcactacaaagggctcttcctcttaccaaaggacattttcctcccccaagctgcttgtcctcgcttttaaatagtagctcctccgtgaataaaggcagaaacatgtggttatagggaagaacaaaggaagataacatctctcacattataatggcaaacaatgatttgaaaatatcggtacaccagctttatccgtaaagcagtttatgtgagtgataactggtagataaatatggaaaagtagccgaacacacttgacacctctctgagcttgctttgtgatatgtgggcagctagaaaaagcagctaattattaggtggctcctttaacatttcctgatggggagcctgtgagcagaaaagagcgggtgcagccctggacagtggtcatgcacggttagcgcgaaacccactgagctgcagacacccgggtcagctcggaggagggaaggagtcgccgtcctgggccacagtctaggggggtggaccgtggtgccgtccctttggtgggactcaccttagtttctaccaacagctaaatatcacagatgcaaagacttgggggagaagcccatgaacattttctgagtcctttaatgtatgataaggaaaaaaataataaaagtcaacatttgtagaaatctaggttttggttttttgtttgtttgtttttttttgagacggagtctcgctctgtcgcccaggctggaatgcagtggtgcgatctcggctcactgcaacctctgcctcccaggttcaagcaattctcctggctcagcctctcatatagctgggactacaggtgccggccaccacgcatggctaatttttgtatttttagtagagatggggtttcaccatgttggtcaggctggtctcgaactcccgaccttaggtgatccacccacctcagcctcccaaagtgctgggattacaggcgtgagccaccgcacctggctagaaatgtaggttttatttttttaatgggatatttggtgattgtatatagtttttagactgatgggtaaaatgttgaaggtctgtattgcaatcctgcctttactttctaaaaaggattcctaaattgatccagcatcaaatcagtgtattttaaccctgacgatgagcagtatagtttcaggtcttgaatagcagggtccccccactataactccctgacagttcttcttgcccattgcacaaacaaaaccagttcatggagaccatggcattgcagtaaagaaagagtttagggccaggcacggtggctcacgcctgtaatcccagcactttgggaggctgaggcaggcagatcacctgaggtcaggagttcaagatcagcctggtcaacatggtgaaaccccatctctactaaaaatgcaaaaattagccgggcgtggtggcatatgcctataatcccagctactcaggaggctgaggcaggagaatcgcttgaacccgggaggcggaggttgcagtgagccaagatcacaccactgcactctagcctgggcgatagagcgagactccatctcaaaaaaaagaaagagtttaattgatgtgaggccagccatgctacatggaagagttattactcaaatcagtctctcctcgcatctgggggctagattttttcaaaaatagtttggaggaaggggtggaggtggctaggcaatgggtgcttgctgccgattggtctgggtgcaatcacaggggtgtgggactcatcctcctgcatgccgagtggcttctgggcgggtccaggaggagccatcacgttggacttgcaaaaaacctgaaaagatatctcaaaaagccaatcttaggttctgcaatagagatgcaggagtaattggagaagttgcagatcttgtgacctctggaatgatggctggcaccttaccagaattcagactcctcacctcctcctagcctggtagggtctctcattagcttaagaaagcttagctccatcctggctaacagggtgaaaccccatctccactaaaaaatacaaaaaaattagccgggcgtggtgatgggcgcctgtagtcccagctacttgggaggctgaggcaggagaatggcgtgaacctgggaggcggagcttgcagtgagccgagatctcgccactgccctccagcctgagcgacagagtgagactctgtctcaaaaaaaaaaaagaaagcttagcaaaggtggttgagtttcgggaaagggctgttattatttaaaccagaaactaggccctgtgtggtggctcctacttgtaatcccagcactttggctgagatcacgccactacactccagtctggcaacagagcgagactccgtctctaagtaaataaataaatccagattgtacattttataatactagagattcattttgtcatatgttaatccaatttactttgttaaaggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtaagtttaagttttagatcagaacggaagggtgcggtggctcacgcctgtaatcccagcacttcgggatgccgaggtgggcagatcacgaggtcaggagatcgagaccatcctggctaacacggtgaaaccctgtctctactaaaaatacaaaaaattagcccggcgtggtggcgggcgcctgtagttccagctactcgggaggctgaggcaggagaatggcgtgaacccgggaggcagagcttgcagtgagcggagattgcgccactgcactccagcctgggtgacagagccagactcgtctcaaaaaaaaaaaaagaaaaaaaagttttagatcagaatgagaaataacacagttggccacttgagggtgctaggtgtttagtatattgctttgctatttgttacgtggtagtactgggtctcagtccatcccccgcactgtatgtacatatatgcatatagttttaaaaactaatatgtaactgtatataagaaatggtcattcgtagaaccacagatcttgagactttgaaggatgcaatgtgtgagcagcagagccagaactagaagtacatgttttacacacataggtgtgtgtgtttatctttatgagaataccggtttttttaggtggggcatgatggctctgcaatcccagcactttgggaggctgagaggggtggatcacttgaagccaggagtttgagagcagcctggccaacgtagcgaaaccttatctctactaaaaatataaaaatgagccaggtgtggtggcatatgcctgtgatccccatgacttgggaggctgaggcacaagaattgcttgaacccaggaggcggaggttgcaatgagccgagagcgcgccattgcactccagtctgggtgacaggagtgagaccctcaaaaagaaacccgtttttgtgatgtgttgtcattcttcctgagaattcaaaaaaaaaaaaatttttttcttttttgagacggagtctcgctctgtcaccaagctggagtgcagtggtgcgatctcagcttactgcaccctccacctcccaggttcaggtgattctcttgcctcaccctcccgagtagctgggattacaggcacacacctccgtgcccagctaatttttgtacttttagtggagatgggatttcactctgttggccaggatggtcttgatctcctgacctcgtgatccgcccacctcggcctcccaaagtgttgggattacaagcataagccaccatgcccagcagagaattcaaaattcttaacaggatacttataaataaactgtgtaagaaagaagtataaatagtctaaaccagaagaaaaacatttaacttttttttttttcttctgagatggagtttcactcctgttgcccaggctggagtgcagtgacatgatctcagctcactgcaacctccacctccctggttcaagcgattctcctgcctcagcctcccaagtagctgggattacaggcgcccgccaccacacccggctaatttttgtatgtttagaagagatggggtttcaccacattggccaggctggtcttgaacccctgaccttcaggtgattcgcctgccttggcctcccaaagtgctgggattacaggcatgagccatcgtgcccggcaacatttaaactttgactttccatttgagtgggctatgtctggtggggtatatttatcatattctgtggagggttttttttgttgttgttgtttttgttttgagacagagtctcactctgttgtccaggctggagtgcagtggcgtgatctcggctcactgcaacctccgcctcctgggttcaagcagttctcccgcctcagcctcctaagtaggtgggattacaggtgcccaccatcacattgggctaatttttgtatttttagtagagacggggtttctccatgttggccaggctggtctggaactcctgacctcaggtgatccacccacctcgtcctcccaaagtgctggcattatgggtgtgagccactgtgcctgacctattctgtggatttataaacaaacagcgtctcccaaagtttattgaacatcttctcaaatcctgtttcaagcacaaaacttttaaccacattcagagggttttaaacgagctttgagatgggtcactagcttctcagaaaatccacatctaaacttctccagtacaccgtgagctgtgctctagccaaagaaaaatggaaagacagagaaaggagttctgagagcctttttttttttttttttttttttttaaggaaaaagaagaatttattcactcaagactaaaaactaaaggcctgggcctgagaactgaatcaggttagtgtgtttgtttgattgttttttttgctttctttgcgtttgagctagtccatgaaaagggaaaggaagggcggtgagagaggtggggaagttcagggcggtccttggcctgctttggggcagtgctcggcacacccctgtccaagttctcttgcacacccagttcccaggcatggctctccaatctcagctccctcctttctctccggattttaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaaagccaagtctgtcattgggctaaagtgccattcctactaatcctttgcctcacctgattcatttggaataaagggccaggagcttgagtcacccccatgccaggacctctgttgctatttgctggctgctggagaggtggggtcttgcgggccctggagaggtggggtcttgtggggcagagctggagcagatgctgcatccagcagtaagcatgagaatgagcactcacagttttgggtcctgtgctggacactgtgcaagtcctgtgcatatatcacctgttgcatttcccacagtgacccaatgaagtagatactgttatctttaccattttatagatgagcaacctgaggcttcaccagaattgcacagtgagaatgtggcgtggcctggattctcacgtcgggagtcggattgcaaagccttactgggcctcgccgcgccccatggctgtcagcgcattccatgctgacctggccgtgtatgcgtgcgtgtgtacgcatgtgtgtgcgtacgtgcacgtgtgtacatgtgtgtgtgcttgtgtgcacaccacatgtgccgtgtccataggtctgtcatcatatcaggtaggactaggtcggctcatagcttggaagggctttggagacagccactctcctaacagatgggagaagttgttttgattcttactaaggtcccagaatcctattgatggctttgctgagtattgaaaggctggccttaaattaggtttgaaactgaatttggtaataggacaggatgtgttaaggaagggaaacatacagggagctgcctgctctggcagctgttgaaagtgagcaggccacggtgcctgcagtgggagtggggcagcaggcgtgtcaccttgggccagagcacatgtcttgtacacggttgcaccaatgcgtgaggatgtaggtccccaagagccaagagaaggggagctttgttgaatacgtgatattggagaaagctttggcccaaaagaacaaatttagattcgttctctctgcaatacaaatgtattccagtgggtcaaaatgttaattattattaatttctttttttgtttcttgagtcagggtctcactctgtctcccaggctggaatgcagtggcaccatctaggcttactgcagccttgacctcctgggctcaagtgatcctcccacttcagcctcccaagtagctaggactgcaggtgcacgccagcaccacacctgcctaatttttgtgttttttgtagagacggagttttgccgtgttgcccaggctggtctcaaactcctgagctcaagcagtccactcacctcatcctcccaaagtgctgggattacaggcgtgagccactgtgcctggccaaaaagttaattattaaaagtcaggccgggcgcggtggttcacgcctgtaatcccagcactttgggaggctgaggcaggggaatcacaaggtcaggagttcgagaccagcctgatcaacatggtgaaaccccgtctctactaaaaatacaaaaattagctggtcgtggtggcacttgcctgtaatcccagctactcaggagactgaggcaggagaatcacttgaacccaggaggcggaggttgcggtgagccgagattgcgccactgcactccagcctgggtgacagagcgagactctgtctcaaaaaaataaaaaaagaaagtcgattgtttatggattaaagagttagatacatagttcgcagctgtagagcatctaataggatataacagactcaccattatctggaggaatgataccgtcctgagcttgagggtgaagacagagatattcaagaacataaaagctgaaaacgtctgtgttaagactccttttgatccaggtttctggacaggagagtttgctgagcatatgtggaggtggctcagtacccagaggcgggtggagctggccccagtcatggcctgtgctcagacgctaggaccagagcaatttcttcctcatgtttaaacttttctcctaggccactgccttacctttctcatgctataaactggctttctctgcctccttgtttatccctcctaagttcaaagaagcagtcagctgaggaggctgcctttcctcaggctggctccagcccggttgggaggtgcccggattagctgaggcagaggtggggcttgtgcagagagcctggctgctgccatggagacgggaggaagcaggcaaaagagcaggcctgctggcaaaggatcagagggctgggtaggcgcagggatcagtgtcccggaaatgtgaggaagggcaagtgctggcagcaaaacaacatgggcaatttggacttcaggaaaagctgccacaaatactcagaaataacacacatttatagacaaataacgtgactacaagaagaaaaaattgttcaaactctaaattttacaaggcatatttgtttatttttttgagatggagtctcactctgtcaccaggctggagtgcagtggcgtgatctcggctcactgcagtctccacctccgggttcaagcaattctcctgtctcagccttccaagtagctgggattataggcacccgcccccacacctggctaatttgtgtgtgtgtgtgtgtttcgtagacggagtttcaccatgttgaccaggctggtctcaaactcctgacctcaagtgatcttctcatctcagtctcccaaagtggtgggattacaggcatgagccaccgcgcccagcctacagtgcatatgcaacaagaagtcatcatttcatgcttactcagttcatgggggaatgttttcagtcttgagactcagtgctggcggagttacatcaaaggtggatggcagcagaaaatcctcagccccttttccagaagaatttagctacacatatttacatataccccaggaagcaggcaaatgatgctcatgaatcatctctaagaattcatgtgagagccaggcttggtggctcatacctgtaatcccaccactttgtgaggctgaggtgggtggatcacttgagcccaggagtttgagaccagcctgggcaacatggtaaaaccctttgtctacaaaaaatttaaaaataaaaataattaaggccgggtgcggtggctcatgcctgtaatcccagcactttgggaggctgaggcaggcggatcacctgaggtcaggagtttgagaccagcctgaccaacatgaagaaactccatctctactaaaaatacaaaattagccagtcgtggtgatgcatgcctgtaatcccagctactcaggaggctgaggcagaagaatcgcttgaaccccggaggcggaagttgcactgaaccgagattgcaccattgcactccagcctgggcagcaagagtgaaactccatctcaaaaaaaaaaaaaaaaaaaaaaagccaagtttggcagtatgtgtctgtagtcccaactactcgggaggctgaggtgggaggatcacttgagcccagggggtggaggctgcagtgagccgagattgtgtcactgcactccagcctgagtgacagagccagactgtctccaaaaaaaaaattcatgtggggaaacatgggaagagttcagctgtgtgttccttgcagcacaatctttcattgcagaagaatgggaagaatggaaatgcccagtactagaagaacggataaggctgtggtggcctacgcacttactggccttcaccggaatattctgcagcagtgcagaaaaatgagtgattgaatttgaagtgcaagcagcagaatactgtgatttcagttctgccagtctcaaaattaaatctcatttgtaaggcaggcagtattgtgggagaattcctctaatgtatttcattcccagagtgtttatgcagtggcaggaagagtaccatcaagatgggtttagtttaagtcagtctcctaagtatttatgaaacacccactcggttttcagtaagtgtggtgaactcggtgttttgcctctttccctgaacttagcggtaggttcggtattaagctgcagtgctgcagtgtggatggtgccctgcttagcagatattacagtgcttctgctgcttgttgagccttggcctgggggtgtttgagccaaatgcaaggagacctgtcctgagggacgcccatgtcaatggagtcaggtggcagcagctggtacccctgcctttgggatactcccgtggtcaccctaacagcagtgaccacaagcaagcacttctgtgccagccgcgcccctcctgccacactgacggagtgtagcttcatgaggtgcgcggttgctgtcacacactagagaggaagaaactgagatggaggtaagtcacagctctggggccacacagccaggtggggacagtcttggcctctgtccatcccagatgaggtctcgctatgttgaccaggctggcctcaagcagtcttcctgcctcaacctctgagtacggacacagttttgagcgccctatatgtgtattaacagtaacacatgagacagagtaggccctctttatccgagggatacattccaagacccccagtgaatgcctaagactgaggctagtaccaagccctgtatgtacactaggtttttccctacacggttgtccctcccctatgtcctcagttcaaccaaccacagattgaaaaatattgaaaacaataaacatataaacaataaaatattgaaaataaaaaatacaattttttctttttagatggagtctcactctgtcacccaggctggagtgcagtggcacgatctcggctcactgcaaactctgcctcctggttcaagcgattctcctgcctcagccttctgagtagctgggactacaggtacacaccaccacacctgactaatttttgtatttttagtagaggcagggtttcaccatgttggccaggctggtctcaaactcctgacctcagatgatccacccacctcggcctcccaaagttctgggattataggcatgagccaccgcgcccggccaaaaatagaaaaatttagaagtacagcataacggccgggcacggtggctcacgcctgtaatcctagcactttgggaggctgaggcgggcagatcacctgaggtcaggagttcgagaccagcctggccaacaatgtgaaatcccgtctatactaaagacacaaaacttagctggacgtggtggcgtatgcctgtaatcccagctacttgggaggctgaggcaggagaatcatctgaacctgggagatggaggctgcagtgagccgagatcatgccactgcactctagcctgggcaacaaagcaagactctgtctcaaaaaaaaaaaaaaaaaaagtacagcatgacaactgttcatacagcatttacattgtattaggtatcataagtaatccagggatgacttaaagcatatgggaggatgcgagtaggttatttgcaaatatttggagacaaagccttgctctgccactcaggctggagtgcagtggcgcgatcgtggctccctggagcttcaacctcccaggctcaagccatcctcctgcctcagcctcccaagttgctgggactacaggcacatgccaccatgcctcgctaatttaaaaaaaaatttttttgtagaatttttttctatgttgcctaggtttattacaacattatattttattttatttatttttcgagatggagtatcaatctgtcacccaggctggagtgcagtggtgcagtctctgctcactgcagcttccgcctctgggttcaagcaattctcctgcctcagcctcccaaatagtgaggactacaggcatctgccaccatacccagctaatttttgttttttgttttttgtggttttttttgttttttgaagcggagtctcactctgtcgccaggctggagtgcagtggccctatcttggctcactgcaacctccacctcccgggttcaagcaatcctcctgcctcagcctcctgagtagctgggactacaggtgtgtgctaccacaccaagctaattttttttgtatttttagtagagatgaggtctcccatgttggccaggatggtctcaatctcttcacctcagatccacccacctcagcctcccaaagtgctgggattacaggcgtgagccactatccttggcctgttgttttttttttttttttgagacggagtttcattcttgttgcccaggctggagtgcagtggcgcaatctcagctcactgcaacctctgcctccttggttcaaggaattctcctgcctcagcctcctgagtagctggcattataggcatgtgccaccacgcccggctaattttttttgtatttttagtagggatggagtttctccattttggtcaggctgttctggaactcccaacctcaggtgatccgcccgtcttggcctcccaaagtcctgggattacaggcgtgagccaccgcgcccagcctgttacaccattttatataaaggatttgagcatcctgaaatgttggtatctgtaggagtcctggaaccaacctcctatcgataccaagggacaacttttcatttttagctatgataaagtttataaattaggcatgagagactagcaatgataactaataaaatagaacaagtgtaacaatatgccagcatctctaatcttgtattttgcaaccattaccaagtaaataagggttactcagacacaagcactgctgtacgacgacagtggatctgatcaccgagacggctgctgagtaactaacgagtggggcgcgtctacactgtggaggtgctggacagagggaggagtcgcctcctgggctggtcggagtaggaccttgggaggtttcatcacgctactcagaacagcatgcagttcaaaacttatgacttgttcatttctggaattttccatttaatattttcagaccccactttacctcgggtaactgaaaccatggaaagaaaaaccatggatggaggggacagctgtgctgccgccatctcccttacacagttgagtaaaccgaggcacagaagaaaatgaagtagccccagatgacgtaggaaatggcagaactgaagggaaaagcagagcagggggctgtagagttaaactgttcttcattccggtggcactagacctgcccgggcggccagaggacacgtggctcctgtcctgtctgccgtgtggctaggggacagccgtgcttgtgctgtgccgtctgagtgtttgtttctgtctgtgggaataaaggggttgccagacaccctccctgctctgtggagggagggtggaatcatgcctttggccactttgcccactcccccttgggccggagcatcagcattagctgtgccacagggtggtatgcgctctgctgaaggtggcaccttcagggaaaggcagtctgccggggaggctagcgagcaccctgggtaggagctgagcgtggcctccgcgcctcctcatgggaagtgctggagatgcaggagcccctgagccagagcccagcgctcttacaagagacctcacttcctgttcggggactggggctgctaagtcagagtgcgcctcctgcacccgccaccctggatgtggttccattccctggtccctgagccatagctggggggcatgagactgtcccctgggctgctttggggaccctacttcagggcagccctgccactccctgtaacgggctgtgggtcctgccctgtggccttcctacctctcttgcgtgtgggtgagcctgagcgtggccaccgccctgggagtgccacagaggcaagcggcactggtcctcatgtgtaaacagccccaccagcacgcggggctggagtagtcaggccgggacctgtcccaggaatgggcaggctgttaacctaggatgcattcaagttaggacacatttcattcccgtgtagcggtggctcccagttcctccgcagaacctgcaggagtgtgcgtgatgaaacccgtcactcgttgtgtatggtagacatacctgcctgggtcgtaatcacttgtgaagaaaatgaattatgctgtgacctttagatacgattcacataccataaaattcaccctgccttttttttttttttttgagatggagtctccttgtcgtgccctgcctaaattcacccttttaaactgtataattccatggcttttagtagtcacaagattgtacaactacatcactaattctgaacattttcatcacctcaagaagaaaccccacacccattagccagtctcaattcctgcctcacctaaccccggcagcccactttatatctctggatttgcctattctgaacatttccagataaatggaatcatacaatatgtggtcttttgtgtctgcctttttttcacttaggttcataatgttttcaagatttatttatattgtctcatgtattagcactttggagatttttttaatggctgtataatattctatacggatataccatgttttgtttatccacttactagttgatgaacatttggattatttctaccctttggctattatgaattatgctactgtgaataatcctgtgtatacctacaggtgaactgctgagttaagagtctttttggcctggcgcggtggctcacgcctgtaatcccagctctttgggaggccaaggtgggcggatcacttgaggtcaggagttcatgaccagcctggccaacatggtgaaacccgatctctactaaaaatacaaaaaattagctgggtgtggtggcgggcgcctgtaatcccagctactcgggaggctgaagcaggagaatttgctggaacccgggaggtggaggttgcagtgagccgagattgtgccattgcactccagcctgggcaacagagcaagactcgatctcaaaaaaaaaaaaaaaaaaaaaaaaagagtcttttttcctcctgagaccaaatacctggtgtcttctctaattccacttctccaactcctcaacaccagctataggtgtccagcaattcagttcaattctgacactgtctacttggagttcatgtctgatgccacaggttaaagacccagtcccacaagattgcctccactgaggcagtctttctctttggataaattcctgtttacatcctttgccggttgccagtcctgggccacttgtccctctgcctgacaggctataaatcagactatgaccccctccacaggattgataatttgctagaatggatcacaacattcagaaaggtgttttacttactcttagcggtttattattaaggatacaactcagggacagccagatagcagagatgcacatggcaaggtatgggggcatgcggagcccctgcgccctctctgggcatgccatcctcccagcaccttttgtttgtttgtttgtttttttgagcaggtctcactctgtcgcccaggctgagtgcagtggcatgatcatggctcactgcagcgtcagcctcctgggctcaagcaaccctccctcggccccacaaagcactgggataacaggcgtgagccaccgtgcctggcctcccagcacctcaatatgttcagtagcccggatgctctctgaaccccatggtttagggatttttatggaggtctcatgaggtaggcatggttgattaaatcattggccgttggtaattagctcaatctctactccctctcctttccccaaaactgaaagttttgagcttccaatcaaggcttggtctttccggcccccatcccgaagcagtacaggagcccaccagagctgccccattcgaacaggagcagctgctatcacccttcatcactcaggagattctgaggttttaggagctctgtgccaggaacaggggacaaagaccaaatacctctctataatgccacgtgggtcttatgatcacgaactctgtgtttaactttttcaggaattacaaagctgtttttcagagtggcctgacctatttttttatttccaccagcaatgtatgagagttctaatttctctacatccttgtcaacacttgttattgtctgtgtttaataatagctatcctagcgggtgtgacgtggcatgcctttgtctttctgatttcccgtggtgttgagcatcttgtcatgtgcttattggttgttcgtgtatcttttttggagaaattcctgtttaaatcctttgcccattttaaaagtggatgatttggccaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaataggatgatttgtctttttgttgctgagataaaaagagttcttggccaggcgcggtggctcacgcctgtaataccagcactttgggaggccaaggcgggtggatcacctgaggttgggagttcgagaccagcctgaccaacatggagaaacccgtctctactaaaactacaaaaaattagctgggcgtggtggcacatacctgtaatcccagctactcgggaggctgaggcaggagaattgcttgaacctggcaggtggaggttgtggtgagccgagatcgtaccattgcactccagcctgggcaacaaaagcgaaactccgtctcaaaaaaaaaaaaaaagttatttacatattctcgatactagacctttattagatggatgattagcaaatgtttttctcccgttctataggttttttctctttttttttttttttttgaaacagagtctcgctctgtcgccaggctggagtgcagtggtgtgaactcggctcactgcaacctccacctcccgggttcaagcaattctcctgcctcagcctcccgagtaactgggactacagacgcacgccactacacccggctaatttttgtacttttagtagagacggggtttcaccatgttggccaggatggtctcgatctcctcaccttgtgatccacttgcctcggcctcccaaagtgctgggattacaggcgtgagccaccatgcccggcccggcccttttttgttgttttttgtttttttttgttttgtttttggagacggagtttcgctgttgttgcccaggctggagtgcaatggcacgatctcggctcattgcaacctccacctcctgagttcaagcaattctcctacctcagcctcctgagtagctgggattacaggtgcctgctaccatgcccggctaatttttgtatttttagtagagacggtgtttcagcacgttggccaggctggtctcgaactcctgacctcaggtgatccacccacctcagcctcccaaagtgctgagattataggcgtgagccactgcacctggccttttttttttttttttttttttaacgagacagggtctggctctgttgcccaggctggagtgcagtggtatgatcatggctcactgcaaccttgaactcctgggctcaggtgaccctccttccccggcctcttgagtagctaagactacaggcatgtaccaccatacctagctaatttttttattttttggagagatgaggtcttattatgttgcccaggctggtcttgaactcctggtcccaagtgatcctcctgcctcagcttcccaagtagctgggactacagacgtgcaccaccacgcccagctaatttttgtatttttagtagagatgaggttttaccatgttggccagaatggtctctatctcttgatcttctgatcggcccagcccggcctcccaaagtgctggaattacaggcatgagctatcacgcctggccttttttttttttgattcggagttttactcttttgcccaggctggagtgaagtggcatgatctgggctcattgtaacctctgccaccccccaccggccccagtatttttagtagagacggggtttcaccatgttggcccagctggtctcaaactcctgacctcaggtgatccacctgcctcggcctcccaaagtgctaggattacaggcgtgagtcaccacatctggctaatatttgtatttttagtagagatggggtttcaccatgttggccacgctggtcatgaactcctgacctcaagtgatcctcccaccttggcctcccaaagtgctgggattataggcgtgacccactgcacctagcctattttgtatttttcagtgtacacatcttacacgtctcctctcaaatttattcctaagtcttttattatttttgatgctatcataagtagaattgttttcttgatttcatttcagactgttcattgctagtgtatagaaatacaattgatgtttgtatattggtcttgtatatatcctgcaagcttgctgaactcatttattagctctaatagttttttgtttatcctttctccttaagtcttaatgtttaagctgaaattacctttcaggtcagaaagcaacattgaatgcagaagaaatggcggacttctacaaggaatttttaagtaaaaattttcagaagcacatgtattataacaggtaggtgtttactcttttcctgaaaatttgaatagcacatccagattaggtaggagtgttttcttacctgaatttaacaacattcatgtttatatcagaggtagaagttgcaagactttatcaacttttttttttctttttttctttttttttttttttttgagacggagtttcgctctctcgcccaggctggagtgcagtggcgccatcttggctcactgcaagctccgcctcctgggttcacgccattctcctgcctcagcctcccgagtagctgggactacaggcacccgccagcacgcctggctaattttttgtatttttagtagagacagggtttcaccgtgttaggcaggatggtctcaatctcctgacctcgtgatccgcctgccttggcctcccaaagtgctgggattacaggcatgagccactgcgcctcgtctatcaactttattttttaagtgactgcagtggcttaaaaagataccaatttttttaggtcgggtgtggtggttcacacctgtaatcccagcactttaggaggccaaggtgggcagatcacctgaggtcaggagttcaagaccagcctgaccaacatggagaaaccctgtctctactaaaaatacaaaattagccagctgctccggaggctcagtcaggagaatcgcttgaacgtggaaggtggaggttgcggtgagctgagatcgtgccattgcactccagtctgggcaaggagaacaaaactccatctcaaaaaaaaaaaaaaaaaaaaaaaacgggttttagctggttacagataataatgacctgtatttacaggtgaaattaataggacatgatatctgagatttgctttaaaatatttgtaggctggatacggtggctcgcacctggaatcccatgactttgggaggccaaggtgggtagatcacttgagtccaggagttcaagaccagtctgggcaacatagtgaaaggcttgagctaggaggaccacttgagcctgggaggttaaggctacagtgagccgagatccggccactgcattccagcctggatggcagacagagtaagaccctgtctcaataaataaataaataagtaagtaattaaaaaaatatatatatatatataaaacagttccagagttacaaagcctgatgggcaggtgaagccagacttcaagaatgtcgacatgggccaggcacggtagctcacacctgtactcccagcactttgggaggccaaggcagatggattgcttgagcccaggagtttgagaccagcctggacaacatgacaaaaccctgtctctacaaaaaatacaaaaattagcttggtgtggtagtgtgcacctgtaatcccagctacaggaggctgaggcaggaggatcccttgagcccaggaggtggaggttgcagtgagccgagatcccgctactgcactccagcctgggctacagagtgagaccctaataaaaaaagagaatatagatacagtcaaaggctggatggactcagtgagggacagtctgacctaaagattagtcctgaaatatctggattccatttctaaggttgtcatgtattactctgaattagttaagtcattcaaacaagcgagtataatctttccctggtctttggacacgtagcttgtttgcacggggcacagtctctgatgggcttcatgttttctctgtggcactcgggtgaagaggaccagccttacccaagatcaggccttagaggagcctggcccccaccaccacctcctgcccctgccttccctgtggcaacagcagaagtgtagcttgcttttacatgtcatagaatcaggtcgtctgtattagtgaaatggaatatggcttttccttgaagaactgtaatccccatgggctaccggttttcttctcctggaagcgcttatttactttgggcactgctcctcatgacagcattgcttaagtaggtggaggtgtaaaggtggtttgcaggtggagaggaactttctgtcctgccatgcagagcctccagagtggtcgtggcccatcacatccctaaaatgctgccagctcggcaggcctggggtttccaagggctctcttggatcttttagcaaaaatcaaaggagtacttaagaggctgaggcagaagaattacttgaacccaggaggcagaggttgcaatgagccaagattgtgccactgtactccagcctggacaactaagcaagatgaaaaaacaaaacaaaaaaaactccaaaggaggggccgggtgcggtggctcacacctgtaatcccagaactttgggaggttgaggcaggtgggtcaggagatcgaaaccatcctggctaacacggtgaaaccctgtctctactaaaaaaaaaaaatacaaaaaattagccgggtgtggtggcgggcgcctgtagtcccagctactcgggaggctgaggcaggagaatggcgcgaacccgggaggcggagcttgcagtcagccgagatcgcgccactgcactccagcctgggcgacagaccgagactccgtctcaaaaaaaaaaaacaccaaaggaggatggtggcggcctccagaaacagggctggagaggactccaggcgtcgccagtgggcctcactctcagcctgaggagaggcaggcctctatgaatagtttagctttaacaagggcagggaaagggcaaagcagttgaggcctggtcagttgaactcatcctcaactgggagccacttctgggccagggcaccaagcctcagtccctgccaccgtgtcacctgtgcatcctctgtttctctacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctcaaaaaaaaaaaaaaaagattattctaggcctggcacggtggctcacgcctataatcctagcactttgggaggccgagtgggtggatcacttgaggtcaggagtttgagaccagcctggccaacatggtgaaacttcgtctctactaaaaatataaaaattagccaggcgtggtggcacatgcctatagtcccagctacttgggaggctgaggcaggagaattgcttgaacctgggaggcagaggttgcagtgagctgagatagtaccactgcactccagcttgggtggcaaagcaagactccatctcaagaaaaaaaaaagattggcctagcgcagtggctcacgcctgtaatctcagcactttgggaggccgaggctggcggatcacgaggtggagagatcaagaccatcctggccaacatggtgtaaccccagctctactaaaaatacaaatattagctgggcatgttggcgcacgcctgtagtctcagctactcgggaggctgaggcaggagaatcacttgaacccgggaggcagaggtttcagtgagctgagatcgcaccactgcactccagcctgggtgacagagcaagactccatcttaaaaaaaaaaaaaaaagattatccagctgggtgtggtggctcatgcctgtaatcccagcactttaggagggcggatcacctgaggtcaggagttcgagaccagcctggccaacatggtgaaaccccgtctctactaaaaatacaaaaattagccgggtgttgtggcaggcgcctgtcatcccagctactcaggaggctgaggcaggagaattgcttgaacctgggaggcagaggttgcagtgagccgagatcgtgccactcactccaacctggatgacaagtaaaactctctctccaaaaaaaaaaaaaaaaaattaacccaaaaatttgtatgctcaagtttttttttaattaggttaatataattgtaacagccatattcaaataaagtatttctgtgggcttttaaatagttacaaaataaagcttatctcagtgatgtgggtttttggtttttttgttgttgttgttttttgagacggtgtcttgctcgttcgcccaggctggagtgcagtggcgcgatctcagctcactgcaacctctgcctcccaggtgcaagcgattctcctgtctcagccttccaagtagctgggactacaggtacgtgccaacacacccagccaatttttgtatttttagtagcgacagggtttcaccatgttggccaggatggtcttgatcgcttgacctcacgacctgcccacctcagcctcccaaagtgttgtgattacaggcgtgagccaccgcgaccagcccactgatgtgttttataccacttttcccacaaaatgcatgtttgttaaaattccaaatattttaaatattttaatttggagtttaaaagcaaaataatattgagtctctttctcccactttgtgtgttgggtggtctttgtagaaactgattttttacctgctcatattcacccaaaaaaaggagccggatgtggctaacagaagttcagcaggactcacgagggctatctcaggtcagtgaaaacaggatatctaatgccttttcctctttctgttttgttttgacacggagtctcggtctgtcactcaggctggagtgcagtggcatgatctctgctcactgcaggcttcacctcccgggttcaagcaattctcctgccttaacctccagagtagctgggattacaggtgtgtaccaccacgcctggctaatttttgtatttttagtagagatggggtttcaccatgttggccaggctggtctcaaactcctgacctcgtgatctgcccacctcggcatcccgaagtgctgggattacaggtgtgagccaccgagcccggccttccttgtttttatttaatcctaataatgtaccggaagctgcacctgcctgcaagcctcagctcccttgaggccatcccgtagctctggcagagcccccagcagggctccagttggcgtcaggtacagcatttgctctgcacaaatgctggagttataatgattaatagaagcatcttcaagaaaaacctccccagggaaaggccgccgtgtggggagcatctttaggagctgcagctggaggacccgggcctgcccacacacatgctgctctttaaaggaagcggaattgcatcagggctacggagaagccttgccttggggcagcagtgctaccctgcttcgatcttttgcgcctaagaggacaaagcttgagagctgttttctgacaagccctttagtctgcttccagcacggggaagtggctgcttccaagcctttgtgcctcaggcacacgctgagccttccgcccccagcagaggagtgagccacagaaggccctttgttctgtacatttgcaaggagtattttagacttctgattaatggagaaaccacgcaactcctggcagattgtatgacagttttctgtttgctgattttttttatttttatttttgctaccagcactttttttttttttttttttaagaaaaacagcaacaaggccgggtgcggtggctcacgcctgtaatcccagcactttggcgtgacccccgcacgaggtcaggagtttgagaccagcctggccagtgtggtgaaaccccgtctctactaaaaatacaaaaattagctgggccatggtggcgcatgcctgtaaccccatctactcaggagactgaggtaggagaatcgcttgaccccaggaggcagaggttgcagtgagccgagatcgcaccactgcactcctgcctgggcgtcagagtgagcctccgtctcaaaacacaatcaaacaaacaaacaaaaaacagaaacaaaaatagctctattctgctgagatttttaaagttaaaattgtaacagtgtgtctggttaggaaatcggagcagcataggaaggagtagatgacaaaggaataggcttcctttctaaatccataattaattttcctgaaggtgaggctggaggttcctgttctgaaagcccccttattgggaggcagccagtagagtttggggtctgggtgctgctggcattttcctccccgtggcccactgggttcgccttcccagagtcttattagattccctctcaggctcccccatgcttgcattatttttttgccttttaacatagatcccttctgaacggtgtgctacagcgccttcattcctttccagagtattttcctctgtgatgcatgctctgcagtggatcagcttttgtcgtggatggctgagcgtgaggctgagccacccctgcctcctggtggatgtgggccgcacccctccagctggtcccacctgccgaccagctgttctggttgctccctcatctataggctgcaagcgtttgaagggaggagatgtggggaatggttaaaatctgtcaatgtttattcagccgagaaatactgagcacctgctctgctgggcacaagggccccgatgttggtagttcattgttgctccccctgcaaagactagcaagatttaaagtaagagaaaaaagccagccacataatgtagaccccaccagaatgttttacagaatcagctgatctgactcatgtttacattcccagttaatcatagatttcaattatattcttttttttttttttgagaccgagtctcgctctgtccccaggctggagtgcagtggcgcgatcttggctcactgcaacctccacctgctgggttcaagcgattcttctacctcagcctcccgagtagctgggactacaggtgcgcgctaccaccaccagctaatttttgtgtttttagtagagacagtgtttcaccatatgggccaggctggtctcaaactcctgacctcatgatccgcctgcctcggcctcccaaagtgctgggattacaggcttgagccaccgtgcccagcctattcttaactttcaattgcagaaggctctctactcacaaggtccagcaattacatctgagtgctcattaataaaaatgatttcttgctatgtcacaatgaaagcactgtgaaattaatagccaagttttaagacatgaaatttctttttttttgagacagggtctcactctgtcccccaagctggagtacagtggcgcactctccgctcactgcaacctctgcctcccaggttcaagcgatcctcctgcctcagcctcctgagtaactgggagtacaggcactggccaccacaccaagctaatttttatacttttgtagagacggtttcactatgttggccaggctggtctcgaattcctgggcttaagcgatcttcccacctcatcctctcaaaatgctgggattacaggcatgagccactgctcccggccaagacatgaaatttcaagtagggatgtacatacaattacaggagcccttcaagtcacctgtcatactccgtacctggcctcatctatctggagcctcaggtgtagcctagaatgccctcacaaccactccccactgcacaaagacacggctcccctatgaaaccgcagtctcccctggctggacaggtgctcctgctctgtgcccctcagtgctctggacaagcctcagtgatttacagaactctggccaggcaaggtggctcacgcctgtaatcccagcacttttaggagtctgaggcaggtggatcacctgaggtcaggagttggagaccagcctggccaacatggtgaaaccccatctctacgaaaaatacaaaaattagccaggtgtggtggtgggtacctgtaatcccagctacttgggtggctgaggcaggagaatcatttgaacctgggagccagaggtggtagtgatctgagattgcgccactgcactccagcctgggaaacagagagagactctgtctcaaaaaaaaaaaaaaaaacaaaaaagcctggcacagtggcttatgcctgtaatcccaatactttgggaggccactgcaggcagatcacgaggtcaagagatcaagaccatcctggccaacatggtgaaaccctgtctctactaaaaatacaaaaattagctgggtgtggtggcacacatttgtagtcacagctactcgggaggctgaggcagaagaatcgcttgaatccgggaggcggagtttgcagtgaaccttgatcgagccactgcactccagcctggcgacgagcaagactccatctcaaaaaaaaaaaaaaaagagtctggatgcagtggctcacgcccgttatcccagccctttgggaggccaaggtggttggatcacctgagggcgggagttcgagactagcctgaccaacatggagaaaccccatctctactaaaaatacaaaaaattagccgggcgtggcggtgcattcttgtaatcccagctactcagaggctgaggtaggagaattgtttgaacccgagaggcggaggttgcggtgagccaagatcacgccattgcactctagcctgcgcaacaagagcaaaagtccatctcaagaaaaaaaaaaaagaaaagaaaagaaaaattctagatttacagaacccactcggccgtcctgtcattggtaatgtgtcagcctctccacacacaccagcatctgcctggcgggggtgagtcatactcatctcgggtatccaggagcctcccactcagagcacttgctccatgaatgaatgcagaggctcatgagaagaggagtgtagtgaggatagacttgtgcttgcctggcatttctggggcccaggcctccccattctgtgcccatgtggctctagaaaggccaaagccacctcctctacagagctgggcacactagccagcatcgctggccaaagctagcccaggccttcccagagcaatgaggaaaaaagacccagcactttcttcccagggggttctgaagtcaagggtgtgagtctggtagtgatcctgcccaaggatgaagtcaactctgcagagcagtgctgagaaatggaaagaggaagattccagacaggaagggtggagtgcctggatccagccatgcctggggcctcagatcaccctccaactttgaggtatttgcttgaaatttgattcaagtttctttacctgcaccccagaagcctgactgacccagattacctcaaatagcacatgcctagagtggcctctgaggtctcagttcttggggtgggggtagtaaagggggtggtgtgatccgagtacatttcaatcaacatccagttggctctgagtcctggggtccacctgaaaccaagccaggctggcagaggccatgagcccatctctgggcctgaccatcagaggcatccccagttgatttcgaacagcctgagataccctctgggaagggagtgtgggtgccaggagtctgtaatgagataatcatcacacagtgagaaggagaggtcatcccagtaagcacctggggggcttgggatgctggcacagtgcaagaggcctgtccctcggggattcttagcgaatgagccttgtcacttgaaaatgaatgtgccattgtaaagaactcaggcaggggcagtggttcatgcctgtaatcccagcactttgggaggccgaggcaagcagatacttgaggtcaggagttccagacaatcctggccaacatggtgaaaccccttctctactaaaactacacaaaaatggccgggtgcagtggctcacgcctgtaatcccagcacttcgggaggtcgaggcaggtggatcacctgaggtcaggacttcgagaccatcctggccaacatggtgaaaccccgtctctaccaataatacaaaaaattagctgggcatgatggcaggcgcctgtaatcccagctactcgggaggctgaggcaggagaatcactgaaacccgggaggcggaggttgcggtgagccgagatcgtgccgttgcactccagcctgggcgacgagtgaaactccgtttcaaaaaacaaaaaaattaactgggtgtggtggctcgtgcccataatcccagctacttgggaggctgggacgggagaatctcttgaaccccgagatggtggtttccatgagctgagatcacgccactccactccagcctgggcggctgagcgagactccatctcaaagcaaaaacaaacaaacaaaaaattagccagacatggtagtggacacctgtggtcccagctcctggggaggctgaggcatgagaatcacttgaaaccaggaggcagaggttgcagtgagctgagatctcaccattgcactccagtctgggcgacagagcgatatcctgtctcaaaaaaaaaaacaaacaaacaaacaaaaaactgatgccactacacacctgttagaatggctgctgacatacaaaacattgactgctgggtgaggtgtcaaagctccagcatcagaaagtggtccactcgagggttggtaagaaaaatttactggcgacagtataggtttgaaaaaggaacgtttggcctgatgtggtggttcaggcccgtatgtaattccaacattatgggagtccgaggcaggcggatcacttgagatcaggagttccagaccagcctggccaacgtggcaaaactttgtctctattaaaaatacaaaaattagctaggcgtggtggtgggcacctgtaatcccagctactcggggggctgaggcaggagaatcgcttgaacccagtaggtggaggttgcagtaaatggagatcacaccactgcactccagcctgggtgacagcaagaatctgtctcaaaaaaaaaaaaaaaaaaaaaaaaaaaagaaaagaaaaaggaacgttttattggaaagaaagaacactgaagaagagggcatcaaggtgcctcagtaacagaggaccgagtgagcttcggtggatttttccttaggggcatttatggaccttaaggtgggagcttaagggtaatttgaaccatattagcgatgtaggtcatgataaataattacatttgtagacatttggtgccttaatgtcagcaagggttgcacagtgagttctgacatgcatgcattctggagagctacagaaattgtagttacttagatattttggggaaagggccgggcacagtggctcatgcctataatcccagcactttgggaggcctaggcaggtggatcacctgaggtcaggaattcgagaccagcctggccaacatgatgaaaccctatctctactaaaaatacaaaaaattagctgggcatggtggtgagtgcctgtaatcccagctactcaggaggctgaggcaggacaatcacttgaacccgggagatggaggttgcagtgagtcgagattgtgccattgcactccagcctgactcaaaaaaatttaaaaaaaaatttaaaaagaaatttttgggaaagaaacctaggaccagatccctgctttagataatagggaagcctaattacttttgaattcctcagataagaagttttgtttctggatggccttcctgatgatcaccaccaggtgatctttgctctccaaacaacaccaaatgcaggtgaggatggagcaacaggaacgctcgttcattgctggtgggaacgcaaaatggcacagccactgtagaagagtttggcagtttcttacaaaattaaacatactcttatcatgcattctagcaatcatgctcctaggtatttatgcaaatgaattgaaaacttattattattattttcttgagacggagtctagctctgtcgcccaggctggagtgcagtggtggaatctcggctcactgcaagctccacctcccgggttcacaccattctcctgcctcagcctcctgagtagctgggactacaggcgcccgccaccgcgcccggctaatttttttgtatttttagtagagacggggtttcaccgtgttagccaggatggtctcaatctcctgacctcgtgatctgcacatctccgcctcccaaagtgctggggttacaggcgtgagccactgtgcccagccaaactgaaaacttatatccacacaaaaccctgtacccggatgtttattgcagcctaattcataattgccaacatttagaagctatcaagacagccttcagttggtggtacatccagataatggaatattattcaatactaaaaggaaacaagacatggagtaattttttttgaaacagggtctcactctgttgcccaggttggatgcagtggtgccatctcggctcactgcaacctctggctcccgggttcaagcaattctcctgcctcagcctcctgagtagctgagtctacaggcgcatgccaccatgccctgctaattttttgtatttttagtagagacatggtttcaccatgctggccaggctggtctaaaacccctgacctcaggatccgcccgcctcagcctcccaaagtgctgggattacaggcgtgagccaccacacccggccaggggaatcttaaatgcatattactaagtgaaatatgcatttagccaatctgaaaaggctacatactgtacaattccaactgtataacattgtggaaaaggcaaaactatgaagacagtaaaaaaatgagtggttgccaggggttaggagggagcgggatgaacaggcagagcacagagactttttagggcaatgaaaatattctggccaggtgcagtggctcacccatgtaatcccagcactttgggaggccgaggcgggcagatcacctgaggtcaggagttcgagaccagcctggccaacatgacaaaaccccatctctactaataatacaaaaattagccgggcgtggtggtgcacacctgtagacccgctactagggaggctgaggcaggagaactgcttgaacccaggagggggaggttgcagtgagcgagattgtaccactgcactccagcctgggcaacaagagcgaaactccatctcaaaaaagaaaaacaattgcctggcatgatggcatgtgcctgtagtcccagctacttgggaggttgaggtgggagaatcagttgagcccagggagattgaggctgcagtgagccaaaatcatgtcactgcactccagcctgggaaacagagtaagaccctgtctcacaaaataaataaaagtggccgggcatggtggctcatgcctgtaatcccagcactttgggaggccgaggtgggtgcatcacctgaggtcagcagttcaagaccagcctggccaacatggtgaaaccttgtctctactaaaaatacaaaaaattagttgggcatggtggagggtgcctgtaatcccagctacttgggaggctgaggcaggagaattgcttgaacccaggaggtggaggttgcagtgagccaagatcttgccattgcactccagcctgggcaacgagcgaaactcttgtctcaaataaaataaaataaataaaataaattttggccaggcacagtggttcatgcctgtaatcccagcactttgggaggccaaggtgggcggatcatttgaagtcagccagaccagcctggccaacatggtgagaccccgtttctactaaaaacaaaaatcggctgggcatgctgaggtaagagaatcgactgaacccaggaggcagagattccattgagccaagatcacaccactgcactccagcctgcgcaacagagtgatactctgtctcaaaacaaaacaaaacaaaacaaaacagcggctgggcaccgtcgctcacacctgtaatcccagcactttgggaggccgaggcaggcagatcacttgaggtcaggagtttgagaatagcctggccaacgtggtgaaaccccatctctattaaaaatacaaaaattaggccgggcacagtagctcacgcctgtaatcccagcactctgggaggccgaggcgggcagatcacgagatcaggagatcaggagatcaagaccatcctggctaacacggtgaaaccccatctctactaaaaaatacaaaaaattagccgggcgtggtggcaggcgcctatagtcccagctattcaggaagctgaggtaggagaatagcgtgaacccaggaggtggagcttgccgtgagtcgagattgcaacactgcactccagcctgggcgacagagtgagactccgtctcaaaaccaaacaaaacaaaacaaaacaaaacaaatacaaaaattagctgggcatggtggtgggcgcctgtaatcccagctactggggatgctgaggcaggagaatggcttgaacccaggagacccaggaggcgaaggtgcagtgagccgagatcatgccactgcactccagcctgggtgacagagcaagactccatctcaaaaaaaaaaaaaaagctgggcacagtggctcatgcctgtaatcctagcactttgggaggccgaggcgggcagaccacctgaggttgggagttcaagaccagcctgaccaacatggagaaaccctgtctctactaaaaatacataattagccgggcttggtggcacatgcctgtaatcccacctacttgggaacttgggaggctgaagcaagagaaccgcttgaacccgggaggcagagtttgcagtgagctgagatcaccccactgcactccagcctgggtgacaagagtgaaactctgcctcaaaataataataataataaataggctgggtttcgtggctcacacctgtaatcccagcactttgggaggctgtgggggtggatcacttgaggccaggagttcaagaccagcctggccaacatggcaaaaccccatctctattaaaaatagaaaaattagccgggcatggtggcacactcctgtagttccagctacttgagaggctgaggtggaagaattgcttgagcccaggaggtggaggttgcagtgagccgagatcgagctagtgcatccagcctgggggacacagtgagactctgtctcagaaaataataagtaaataaataaatatgacagtgcgtgtgtacagttttccattctaaccactttccttttttttttttttttttttttttttttttgagacggagtctcgctctgtcacccaggctggagtgcagtggcgcaatcacggctcactgcaagctccgcctcccgggttcacgtcattctcctgcctcagcctcccgagtagctgggactacaggcgcccgccaccacgcccagctaactttttgtatttttagtagagacggggtttcaccgtgttagccaggatggtctccatctcctgacctcatgatctacccgcctcggccttccaaagtgctgggattacaggcgtgagccaccgcgccccgcccattctaaccactttcaagtgcacaggccactgtcactgagcacgctcacactgttgtacaagcaccgtccatctccagaaatctttcatcttcccagactgaaactctgtctcccttaaacaactccccagctcccactcccagtccctggcaaccaccatgccacttcctgtgtctatgaatttgcctgctttggggacctcaagcctagtgtttgcctttttgtggctggcttatttcactagcttatttcagcacaggtcctccaggtccatctgtggtgtagcaggtagacacctgttgcagacagataagccaagtcccagtctcggctatgccacttgagccctctgagcctcagacgctgctgtagactgggaatagtgacccttcaccacaaaaggtacatgaggggtccacttacgttcctgggaggacagcagggtccttggtgacttattctctggatacttccgaatacctcctgcgtgccaggccctgctgtacccctaggaatagagccgtaaagaagagggccaccaccccccctctccacccactttccttccgcccagcagtaccccagctcagacactccgctcacctcactggtctgccaggaaagtcatctctttccttttatgctgttgaaaatgggttggtcaatatcccagaagtgttcagggtgcttcaagttgcattttgagctcctcagctattgattgggaagaataattgtcttcactttatcctgagtcaggcctttggtggaaaagtgcaggaaaggctataggaggaggtggccagggggccttctgtccaggtatttaggggttatgagctcctctgggcccacccccgctgacaacatcacacctccagccaagcacacacttgacccaaagacctgagtttgccatcaaagcagatccagggtttggttcggagtggaaagattaacatgaaaaaagctggagtggtaggcagaaaggcctagagaagatctgtctgtctgtctgtctgttttattcccccaacccctccccaccagccacacccagattgaggagcaccagcagccatgggctggcatgtgacaggctggtcagtgtgctgggaacacagttctgggcagaggatctgatgctgaaaagagcctcagtgtatcttcagtgcctcctcccctgtccctggtggtctgggtgtccagtgcagccctggtctggcccagcaatctctctgatagggtcatggcaggatgcctgtcagggtgtggtggcacgtgcctgtagtcctagctacttgggaggctgagacaggagaattgcttgaacccaggaggcagaggttgcagtgagccaagattgcgccattgcactcccacctgggtgacagagtgagaatccatctcaaaaaacaaaaacaaaaacaaaacaaaacaaaaacccagcctgggcaacacagggagaccccatctctacaaaaaattagaaaattggccgggtgcggtggctcacacctctaatcccagcactttgggaggccgaggcaggcagatcacgaggtctggagatggagaccatcctggataacatggtgaaaccccgtctgtactaaaaatacaaaaaaattagctgggtgtggtggcaggcgcctgtagtcccagctgctggggaggctaaagcaggacaatggcatgaacccgggaggcggagcttgtagtgagccgagattgtgccactgcaccccagcctgggcaacagagcaagattccatctcaaaacaaaacaacaacaaacaaaccagcctgggcaagacagggagaccccatctctacaaaaaattaaaaaattagctgggcagggtggcacgtgcctgtggtcccagctactcagaaggctgaggagggaggatctcttgagcctaaggggtcgaggctgcagtgaaccctgatcacgccgctgcgctccaacctgggtgccaggagccagagattgcagtgagacgaggtcgcaccactgcactccagcctgggcaatagaatgcaactccgtctcaaaataaataaataaaaataaataaataaagtgtgcagttcagtggcaccaagtacattcatggcagcctcgccaccgtccatcttcagaactttgtcatctccccaaacaagcgctgtacccattaggcaggcactccccatccccacccaccattcacttttctctctttctttctttctttctctcttttctttttctttctttccttccttctctttctttttctttcttttttttttcttttagatagggtctcattccgtcacccaagctggagtgcagtggcactatcttggctcaccaccacagcctcagcctccccaagtagctgggactacaggtgtgtaccaccacaccttgctaatttttaaattttcatttgttttagagacaaagtctcactgtgttgcccaggctagtctagggatgagagcctcctggatttggggtggggccctgaaagacacagagacacacagcagggaagagcagatgaggtggaggcagaggctggagggacgtagctgcaagcgcaggagcaccaagggccggtggaaccgcagaaaccgcagcgagggagccagccctgctgacactttgattccggacttccatcgcagaactgagagagagaatcaacccctgtcgtcctgagcccccagcgtgtggtgctgtggtgcagccgcaggaaacacgtgctttccagaatgacagctggtgtccgcaagaacagcaggaactcatcagcatttggaagtgagactgggtggatgtgcagtcccggaaaaagaggcggagatttatgtctggtggcggggagcccgtgtgttcagcagcttctggaaggaattgatagatggaagctgctagaggcgttgctgacagcctctccttgaggccagactccagagctggaacctggtagaagccttagtctcctcatttaccgcagcggtgacgggtggggcagtgtgagatctgagccgagggcccgcatcaaagtcccctttcggcttctccatctgtgacatgggttgcacctgctctgactgctgcttacgagagatggtgagcagtgttctgtgctgcgtggccgtgactgccgaggttctgtgaagacgggaaccacgggctgaaagcaatagagaccccagaccaccagggtcagctcgcccccgcccccacccatcttctttctgaaggctgcgcttttccttttcaatatgacctaagccctttgcaggatatctccattcgcacatttccttactcagggtctgggtctgccctgcagagctgagctgaacggcactatcaggactttctactgggacaattgaatgcgacccccctcccaccgtcggctctgccctcctcctgtttccacaggtctggagacgttccctctgcccaggtgggggccgtggctggaagtccgcctctgctggaggtgcccgaacctcatgcctcttgcccccagatcgcctttcccttggacgttgcccgaggcgtgtggtcccagttggccaacatggagcttagttgggaggatgtgagtggccctctcctcccaaagatgatcgtgaatcctcgggggctgagaaacctgctgagagagaaagaaaacagtgggaatagtgcctacagctgcgcttcctcagtagacaggaggcagggctgctgggggagggaaaagggaagccggccggggtgggggtggagaaggtggggtctctggaggagaactcatcctggaggagtttaacaataggagaggtgggtgggagcatggaggtgtctcccatacaccacccctgcctctgggggtagaggtgccaccccaaggaacagggcttgtgaactcaaagaacacttgagaggattgggccgccccagcctgcatgcccatccccagcctgctacagtgtgttcctgggggggcctgtgggcctaagccaagcagtgcctggcattctcttggccacagacaagggtccaaggtgggctggtaaccttgggaggtggaatccaagtgaagcctggggcattatcgatgctttgggggacaagcttctcctgctggacagtggggactgcagatacaacgtctggaactgctctggccatttctgcctctacagaggagccagactgacctccagccacacagccatgcagacactgggaggcagagccaagaaagctgtagggacccccagtgtagggtccgggagctcaagggcaaccacagcctgctcatctgggtgcctacatgagccaacagcccttctgtagtttaaccagttgaatcatctaggattccagcaagaaataggattcctgggccaggcacgatggctcacacctgtcatcccagcactttgggaggctgaggagggtgagggtggatcacctgaggtcaggagtttgagaccagcctggtcaacatggtgaaaccccatctctactaaaaatacaaaaattagccaggtgtagtggcgggtgcctgtaatcctagctacttgggaggctgaggcaggagaatcacttgaacctgggaggcagaagttgcagtgagctgagattgcgccactatactccagcctgggcgacagagtgagactttgtctcaaaaaaaaaaaaaaaaagaaataggattccccccagagggattgaaggagacttgactgaaagggccagatgggtgaatagggatttggaaacaaaccaaggatatcagggtgcccagagactaggaacagagagaagccaaagggacaaggggaaggcatggcacctgatgggagctgcctggtgagagaaacagtcaggaaggactacaggagctaggacaccaggggatcacatccttccctagcaccttcacggggagtatggtcctgccaacaccgtgatctagaacttctggcctccagaacggtggaacgatacatttctattgtttatgccactctgtttgtggtactttgctacagcaaccctacaaattaatacccacctcttggggcaaacccaatcagaagccaggcattgaaggagcctgggagagcagtctgcagggaaggcctcccaaggcataaaaagcaggattgaggaggggcagtgtggcaaaaggagaacagccagaatgccagatgccccttcggctggaaatgaggagaggggaggggactgaatacatggactgctctctcctcccacccaggcctcctcctgggcttccctgttacaggttgaattgtgtgcccccaaaattcatatgttgaagtcctaaccccagttagtaccttatttggaactagggtcattgcagatgtgattaaagtggggtcctactagagtaggggaggcccctaatccaacatgactggtgtccttataaaaggggaaatgtgggccgggcatggtggctcacatctgtaattccagcagtttgggaggccgaggtgggtggatcacctgaggtcaggagttcgagaccaacgtgaccaatatggtgaaaccctgtctctaataaaaatacaaaaattagctgggcgtggtggcatgctcctctagtcccagctactcaggaggctgaggcaggagaattgcttcaacctggaaagcagagcttgcagtgagccaagatgcgccactgcactccagcctgggcgacagagccagactccgtctcaaaaaaaaaaaagaggcagggggtgacgtgagctgggcatggtggctcacatctataatcccagcactttgggaggccgaggcgggtggatcatttgaggtcaggagttcaagactaacctggcaaacatggtgaaaccccatctctattaaaaatacaaaaattagtggggcgtggtgtcaggcacctgtaatgccagctatttgggaggctgaggcaggagaattgcttgaacctgggaggtagaggttgcagtgagcggagattgcgccattgcactctagcctgggtgacaagagtgaaactcggccgggcacagtgtctcacgcctgtaatcccagcactttgggaggctgaggcgggcagatcacttgaggtcaggagttcaagaccagcctgaccaaactggtgaaaccccatctctactaaaagtacaaaaattagccgggcgtggtggcaggtgcctgtaatcccagctacttgggaggttgagacaggagaattgcttgaacccagcaggcagaggttgcagtgagctgagaccaggcaattgcactccagcctggacaataagagtgaaactctgtctcaaaaaaaaaaggaaaaaaagaaagaaagaaaaaaaaaagggaagtgtggacagagccatgaacacagggaaaatgccatgtgaagattttgagttatgctgtcacaagccaaggaactataggagctaggacaccaggggatcacatccttccctagcaccttcacggggagtatggtcctgccaacaccgtgatctagaacttctggcctccagaacggtggaacaatacatttctattgtttatgccactctgtttgtggtactttgctacagcaaccctacaaattaatacctccttcttagggcaaacccaatcagaagccaggcattgaaggagcctgggagagcagtctgcagggaaggcctcccaaggcataaaaagcaggattgaggaggggcagtgtggcaaaaggagaacagctggaatgccagtttggtgggttgtctgttgactgcaaccagaagtctccaaacctcaacacagaatttggtaccaggagtggggtgttacaagtgaagagactaaaacatggagtggtctgagctaagggggtaaaaatggaagatggtaaggaccccactctaccgagttgggaaatggccatggggtagcacaacagctggttgtagctaaggtgggaggatcacttgagcccaggtgtttgaaactagcctgggcaacatagtaagacgttgtctctaaaacaaataaaaactaaaaaattagctaggtgtggtggtgcacacctgtagtcctagctacctggggaggcagaggctgcggtgagccaagatagtgccactgcactccagcttgggcgacggaataagaccctatctgaaaaaaagaaaaagaaagaaaggaaaaagaaagtgaatggtgggtgccagggactgagtgagggggatggggagtgcctgcttaataggtaatgggaacagggcttgtttggggagatgagaaatttctggagatggatggtggcagggctgcccaacaacatgaatgtacttggtgccactgaactgcacactttatttacttatttattttttaatttttatttatttatttattttttagacaaagtccttgctctgtcacccaggctggagtgcagtggcacgatctcggctctctgaaagctctgcctcccaggttcacgccattctcctgcctcagcctcccgagtagctgggactataggtgcccgccactgcgcctggctattttttttgtttttagtagagccggggtttcaccgtgttagccaggatcgtctcgatctcctgagctcgtgatctgcccgcctcggcctcccgaagtgctgagattacaggtgtgagccaccatgcctggctctatttttatttttttgagacagagtcatgctctgtcacccaggctggagtgcagtggtgaaatcttggctcactgaaacctccacctttcgggttcaggtgattatcccacctcagcgtcctgagtagctgggattacaggtcccaacactacgcccggctaattgttgaatctttagtagaggcggggtttcaccatgttgtccaggctggtcttgaactcctgacctcaagtgatctgcttgccttggcctcccaaagtgctgggattataagcatgagccacagcgctcagcctaaactgcacactttaaagtagttaagatggcacattccatgttgtgggtattttaccacaatgttaaaaaaaaaaaaggaaggccaggcacagtggctcacacctgtaaccccagcagtttgggaggccgaggcaggcagatcacctgaggtcaagagttgagaccagcctgaccaacatggagaaacccgtctctattaaaaacacaaaattagccgggcatggtggcacacgcctgtaatctcagctactcgagaggctgaggcaggagaatcgcttgaacctgggaggcggaggttgcagtaagctgagatcatgccattgtactccagcctgggcaacaagagcgaaactcaatctcaaaaaaaaaaaaaaaggaaaagaaaagaagcaagacacttgtcacctaagatcctatcagctaaacatggtttctttgtacaaatctgtgttttctggcttttccacaatagagatatattatctgtgtaataagataaacacgtggccgggtgcagtggcccattcatgcctataatcccagcattttgggaggccaaggtgggaggatcacttgagcccaggagttcaagaccagcctgggcaacaaggtgaaacctcgtctctacaaaagacacaaaagttagctgggtgctgtggcgtgtgcctgtaattccagcactttgggaggctgaggtgggaggattgcttgcatccaggagttggggaccatccttagcaacatagcaagactgcatctcattaaaaaaaaatttggctgggcgtagtgtctcacatctgtaatcccagcaccttgggaggctgaggcaggcgaatcatctgaggtcaggagtttgagaccagtctagccaacatggtgaaaccccgtctctactaaaaagacaagcattagctgggtgtggtggcacacgcctgtagtcccagctacttgggaggctgaggcaagagaattgcttgaacatgggaggtggaggttgcagagctgagactgcaccactgcactccagcctggatgacagagactctgtctcagaaaaaaaaatgtaaataaaaaaaaaaggaaaacatttaataaaacatatgattttgtatctgtatatatcatgtctctactcttcaggaacatcaatgtcctggtagacacactgggggcgctgttctacaataaaagaagtgaaaaaacatgacaagtaaatgccattggatccagacttaaggaaaattgttctccaggacattactgggacacttggtgacatttaatcaaggactgactgtagacagtactgtggtctcagtgctgtgtctgctgggtttgatgatacgccgtcgttcttagcagaggtaggctgaagcatttaggagtgaagggtcattatatttgcaacttattcccaaatggctcaatcaaatcataatggccccttctagctcttaaaagtcatgaggcggccaggcctggtggctcccatctgtaatcccagcactttgggaggctgaaacagacggagaccacagagtggggaaccggactggagtcatcagctcctgtttcccagcccagtgtggctcctcatgggccatgattcaggactgaattcagttccttcctttttccttcccttccctccctccttcctttaatgccaaccaccctgtgtatcatcacaggggccacagagatgagcctgacctcggctgtgtgggaggaggcaacactcacctaagcagggacgtgaggcagaagtgctagtgcttctagagataacgatacctctccatgcccaagaagcagggctcacagcaggccatgcatgctccaacgaacaggatcatgccgggaactgagaagaccccaggggatgtgcaggccaccactgcagcttgatgaaccaccccaagatgtagcggcatttaaaacactattttatttgtaatcccagcatgttgggaggccgaggtgcgcagatcatgagatcaagagatcgagaccatcctggccaacatggtgaaaccccgtctctactaaaaatacaaaaatcagctgggcgtggtggtgcgtgcctgtagtcccacatactcgggaggctgaggcaggagaattgcttgaacctggaaggcggaggttacagtgagccgagattgcgccactgcactccagcctgggcaacagagcgagactccgtctcaaaaaaaaaaaaaaaaaaaaaattagccaggcggctgggcacagtggctcactcctgtaatcccagcactttgggaggccaaggcgggcagatcacttgaggttaggagttcaagatcagcctgggcaacatggtgataccccgtctctgctaaaaataaaaaaattacctgggcatggtggcacagcacctgtaatcccagctacttgggaggctgaagcaggagaatcacttgaacctgtgaggcagaggttgcagtgagccaagatcgtgccactgcactccagcctgggtgacagagtgagactgtctcaaaaaaaaaaaaaaaaaaattagccaggcatggtggcatgcacctgtagtcccagctactcaggcggcagaggcaggaggattgcctgagctcaggagattgaggctgcagtgagctatgattgtgccactgcattccagcctgggcaacagagcgagaccctgttcaaaataaataaataaataacaatttcattatgctcagattctgtgggtcaaagatttggacaaggcacatcaaggatggcttgtctgctcctcaatgtcttaaagactgacacagtggctagggtttggagtgctccaaggacatgttcactcacagctcagccggtgatgctggctgtcacgactgggcttctctatgaggtgttgtcgtgtcccccaccccagccccccagtggctgtttgggcttcctcacagcatggcagctgagatccaagtgtgagcttcccaagagagccaggtggaggctgtatcacctctttgttttttttggagacagagtcttgctctgtcacccaggctggagtgcaatgatgtgatctcggctcactgaaacctccgcctcctgggttcaagtgattctcctgcctcagcctcccgagtagctgggattacaagcatctgccaccacacctggctaatttttgtatttttagtagagttggggtttcaccatgttggccagactggtctttaaactcctgacctcaggtaatccacctgcctcgtcttcccaaagtgctgggattacaggcatgagccaccgcacccggcctgtatcaccttttaaaacctggcttacgagattgtgccattgtactccagcctgggcaaaaaagagaaactccgtctaaaacaaacaaacaaacaaacaaaacctggtttagggccgggtgttgtggctcacgccttttatcccagcactttgggaggccaaggtgggtagatcaccttaggtcaggagttcaagaccaggctggccaacatggcgaaatggtgaaaccccatctctactaaaaatacaaacaaaaaaaaaaaattagctgggcttggtggtgggtgcctataatcccaccactttgggaggctcaggagggtggatcacctgaggtcaggagttcgagaccagctggccaacatggcgaaatggcaaaatcctgtccctactaaaaatacaaaaaaaaaaaaaaatgagctgggagtggtggcgcacacctgtaatcccagctacttgggaggctgaggcaggagaatcacttgaacctggggggtggaggttgcaatgagccgagatcatgccattgtacaccagcctgggcaatggagtgagactctgttgcataaataaataaataaataaacctgggcctggtgcggtggctcatgcctgtaatcccagcattttgggaggccgaggcaggcagatcacgaggtcaggagtccgagaccagcctggccaacatggtgaaaccctgtctctactaagaatacaaaaaattaggcaggcgtggtggtgggtgcctgtaatcccagctactcaggaggctgaggcaggaaaatcgcttgaacccgggaggcggaggttgcagtgagccgagatggcgccattgcactccagcccgggcaacagggcgagactccatctcaaaaaaaaaacaaaacaaaaaaacataaacctggcttagtcctagagtgttacttccactgtagtcacaggcctgtccagactccaggggaaggcatattgattctacctcatgtgggagaacgtcgaagtcttactgtgagaagaactgtgtaaggggagatggtgaggcagcctgaaggacggctgattattttctcccaagacggcagctgcacgacacctgctgtacccttcctgcttgccacccccatctccagtccctccacattttgggcacatattccaatattcttttttggtggcagaatcattggtttacggggtggcttctgaagggactctgcaccttgtgggcggggctgtggccgagcagccagcctttcttccctgcaggagcctggatacctcccggccctctctaatcacccagacccctggccactgaatccaagcaaagccccctccctgccgggaccctggggctgttctgcagggaaacgtgagtctctcatgtttccctgcatgtatgatcagcggcactgactcctttgttccagcccatcctctcaagcatgttggtgtagcaaattaccttcaacaaaacataacgtagccttcctgagtggaatacgggcggcctttccagccagctcctgggcacagggatcctctcctggaatgcacacgagtgtgtgtgcaggtgtcatccagccctcttcacattgccctgtgggaactgtgggaaccgagctcaggaaccagcaccacagtgctgagactcaggccactgtagacctgtgagtaaaaatctgtcctgtctcatatccaggcgttggtgtcctttgtcagcatccgtgaaccagtggcaggccaccttgttagcttgcagctaaggtaaaatctcagaaatttcaggccgggctcggtggctcacgcctgtaatcccagcactttgggaggacaaggcgggcagatcacctgaggtcaggagttcgagactagcctggccaacatggtgaagccctgtctccactttaaaaaacacaaaaattagccaggcatggtggcggttgcctataattccagcccccgaggctgaggcaggagaatcacttgaacccgggaggcggaggttacagtgagctgagatcatgccactgcactccagcttgggtgacagagcaagactccgtctcaaaaaaaaaagcaaaagagttgaacaaacatttcacaaagatagatatataaatggccaataagtacatgaaaagatgttcagcatcttacgaggcaaatgcaaattaaaaccacaaagaggccgggcacagtggctcacgcctgtaatcccagcactttgggaggccaaggcaggtggatcacgaggtcaggagatcaagaccatcctggctaacatggtgaaaccctgtctctactaaaaaatacaaaaaaaaaaattagccgggtgtggtggcgggtgcctgtagtcccagctactcgggaggctgaggcaggagaatggcgtgaacccggaaggtggagttgcagtgagcccagattgagccactgcactccagcctgggcgacagagcaagactccgtctcaaaaaaaataaataaataaaaataaaaaataaaaaaataaaaccacaaagaggccaggcacggtggctcaagcctgtaatcccagcactttgggaagccgagtcgggacgatcacttgagtccaggagttcgagatgagcctgactatcatggtgaatccccgtctctactaaaaatacaaaaattaggggccgggcgcggtggctcacacctgtaatcccaacactttgggaggtcaaggtgggtggatcacttgaggtcaaaagttggagatcatcctggccaacatagtgaaagaaaccccgtctctactaaaaatacaaaaattagccagacgtggtggcaggcccctgtaatcccagctcctaaggaggctgaagcaggagaatcgcttgaacctgggaggtgaaggttgcagtgagctgagatcgcaccattgcactccatcctgggggacaagagcgaaactccatctcaaaaaaaaaaaaaaattagccggtcgtggtggcatgtacctctaatcccagctacttgggaggctgaggcaggagaatcgcttgaacctgggaggcggaggttacaatgagtcgagatcgtgccattgcactccagcctgggcaacagagcaagactcagtctcaaaaaaaaaaaaaaattagccgggcttagtggtgtgcacctgtaatcccagctactcaggaggctgagatggaagaattgcttgaacccaggaggcagaggttgcaatgagccaagatagtgccactgcacttcagcctgggtgacagagtgagactctgtctcaaaagaaaaaaaaaaaaccacccacagagagaactacacgttcaccagaatgactcagattcaaaagactgatgccaccagacgctggggaagacgtggaacaactggaatgcccatagctcactgatgggagggatagatgggcagtcacctaggagaaaggcctggaagtttctttctttctttctttctttcttttttttgaaaatagagtctctgttgcccaggctggagtgtggtggcatgatcttggctcagtgcagtctccgcctcccaggctcaagcgatccccccacctcagcctcctgagtagctgagactacaggtgcatgccatcacactcagctcactgttatatttttagtagagacggggatttgccatgttgcccaggctggcctcgaactcccgggctcaagcaatcctcctgcctcagcctcacaacatgctgagattacaggtgtgagccactgtgcccaaccagaagtttctttttttttttttcctgagatggagtcttgctctgttgcccagagctggagtgcagtggcgtgatctctgttcactgcaacctctgcctcccaggctcaagcaattctgcctcagcctcctgagtagctgggattacaggcacgtgccaccatgctgggctaattttctttttcttttccttttttttttttgagacggagttttgctcttgttgccctggctggagtacaaaggcacgatctcggctcactgccatctccacctcctgggttcaagtgattctcctgcttcagcctcccgagtaactgggattaccggtatgtgccaccatgcccagctaattttgtatttttagtagagatggggtttctccatattgattgggctggtctctaactcctgacctcagatgatctgcctgcctcggcctcccaaagtgctgggattacaggcgtgtaccaccgtgcctggcctaatttttgtatttttagtagacacagggtttcaccatgttggcaaggctggtcttgaactcctgatcttgtgatctgcccacctcagccccgtaaagtgctgggattaacaggcgtgagccaccgtgtccagcccagaagtttcttatagaactaaacatatgcctggccgggcatgatggctcacacctgtaatcccagcactatgggaggctgagatgggtggatcacgagggcaggagattgagactgtcctggctaacacagtgaaacccctgtctctactaaaaatacaaaaaattacctgtgcgtggttgcacgcacctgtagtcccagctactcaggagtactcaggaggctgaggcaggagaatcacttgaacctgggaggcggaggttgcagtgagctgagatcacaccactgcactccaccccgggcaacagagggagactccgtcttaaaaaaaaacaacaaaaaacaaaaaaacaaaaaaaaacaagcaaacaaacatatgcctacctgatgacccagcaatttcattcctaggttttgttgctgttgttgttgtttatcatctgaaatacagtcttgctctgttgcccaggctggaatgcagtaatgccatctcggctcactgcaacctccaccttttgggttcaaacgattctcatacctcagccccttgagtagctggggttacaggcatgtgccaccacgtccagctaattttttttgtagttttagtagggacagggttttgacatgttgtccaggctagtctcaaatgatctgccctccttggcctcccagaatgctgggactacaggcatgaggcactgtacgtggccttcctaggtatttacctaagagaaatgaaaatacatgttcaccaacaggcttgtataagaaagctgagattacctttactcgtatcaaccaaaatggaagcatcccagcttctatcagcaggagaatggcaaacaaatgtgggacaatgtggatgaatgtcaaaaacaggaggtgagtgaaagacgctagacacagaagtagatgctatgtgacttcatgtaaaatgctagaacaggcaaaataggtctacatttaaaaaataaaaactggggtggggcgcgatggctcatgcctgtaatcccagcactttgggaggtgagcagatcacctgagatcaggagttcgagatcagcctggccaaaatggtgaaaccccatctctactaaaattagtagggcgtggtagtgcgtgcctgtaatcccagctacttgggaggctaaggcaggagaactgcttgaacccgggaggcggaggttgcagtggactgagattgcgccatcgtactctagcctgggtgacagagtgagactccatctaaaaaaacaaaaaaccaaaaaaaaaaagaaaaaacagcccaggcatggtagctcacgcctgtaatcccagcactttgggaggctgaggcaggaggattgcttgaggccaggagttcaagaccagcctgggcaacatagtgagacctcctcgctacaaaataaataaaaaataaataaactgccgggcgtggtggctcatgcctgtaatcctagcactttgggaggctgacgtgggcggatcacttgaggtcaggagttcaaaaccagcctggccaacatggtgaaacctcatctctactaaaaatacaaaaaaataagtcaggcgtggtggtgggcgcctataatcccagctacttgggaggctgaggcaggagaattgcttgaacctgggaggtggaggttgcagtgagccgagattgtgccactgcactccagcctgggcaacaaagtgagagtctatctcaaaaacaaacaaacaaacaaacaaacaaacccaagagtggttgcctggggtcagatgggaaggggcatgaggcaaccctgcaatgtgatggaaacgttccatttcctggtagggacttcagttacacaggtgaaaggtttctcacaactcatcatatcattatacttacatgtgtcaaaacccatagaatatccagtactgtgtacaatacagacagtgagcccttatgtaaactctagacttagttaatatatgaatatcggtccattggttgtaacgaatgtaccacactagtgcaggatgttagtggtaggggaactgggtaccggacatacatggcagttctttgtacttttcgctcaaattttctgtgagcctaaaactgctttaacgaaacacaattaaaaatgaaacaaaaccggccgggcacggtggctcatgcctgtaatctcagcactttgggaggccgaggcaggtggatcatttgaggacagaagtttgagaccagcctggccaacatggtgaaaccctaaaaatacaaaaattagctgggcggtagtggcgtgtgcctgtaatcccagttacttggaaggctgagacatgagaattgcttgagcctgggaggtggaggttgcagtgagctgagattgcaccactgcactccagtctgggcagccgagtgagaccctgtctcaaaacaaaacaaaacaaaaccactgtttagtctctgaaataaaggtcaatatcatataaagcaaaactcttcaaatgctgtccttaagatttatgcattttaccacgtgtaaatgtttcctaaaacaaacaagcaaagaatatcggattccattaatgctatgaatgctgaagcgtctagaggtggtgtgtactgatctttgcaatttactttgaaatgcattaaaaatgtattgatagatagaagaatggggagaagagatgtgataaaggaaataaggccatatatatatatatatatatatatatttttttttttttttttttttttttttttttttttgtagacggggtcttgttctgttgcccaggctggagtgcagtggtgtgatctcggctccctgcaacctctgtctcccaggttcaagcaattctcctgcctcagcctcccaagtagctgggactacaggtgcgccatcacacccagcgaattatttgtacttttagtagagatggggtttcgccatgttggccaggctggtcttgaactcctggcctcaagtgatccacctgcctcggcctcccaaactgctgggattacaggcacaagccactgcgcccagcccaggcaaaatgttaatggtagaatcctggtggtgggtatgtgaacgttcactggacagtttgttatttttttttgagacacacggtcgtgctctgtggtccaggcaagagtgcagtggcatgatcatagttcactgtaaccttgaacttctgggctcaagggagcctcccatctcagcttccagagtagctgagactacaggcgtacaccaccaggcgtggttaatttttttctttaaattttgtgtacagttggtgtctcactatgttgcccaggttggtcttgaactcctggcctcaagcaatcctcttcccttggcctcccaaagtactgggattacaggtgtaagccaatgcacccagccttcactgtacaggtttttcaactcttctgtaaatgtattttcataataaaatgttgggagaaaatctccaatatggaatctgttttccatggcaaatccctaatcgcaggtaccacagccccactgtttccctctatcagtgttcttcaaaccattttgaaattatctggaggacataggtgtcttcccttctcccagtttctggcataaccttttggataactatataaaacacgtccagtctccatgccacatactgtgggaagtccagcactttcctcaagatatctcatgattccttgagaggaagtgaagtggggtaaatattatcctggtcacttggagtgctgtcgccctggcacctggctcaagtccagagacacaggtcgggctcagtcggcataggacgaactcagtgtacccagccaggctgagcttggtcggtgatgtcttcctccctgctgccatttgagcctcagtcctcatctgcagaaattctggtcccaggggaccgcccagacggcttccctcgctgcctggcgcctccagctgtcttaaagcttcggccggcactggcgcagcctccctccagctgtaccaggaaacaggacacaaatgctgagggtctgggtcaccaggccatgtgaggaaaccagctaccacaaccagggcttgctgagacaggatcccaggtgtgggggacagtgctgctgagccgtcacggtggcctgctggccctgggagaacccagggctctgttctctcaggggcccctgggctgtcctgcgggagtggagtgggtgtgaaggacagaaagacagactgaggggtggcttcctgccagggtgtccaccacacctccttccgatcttgagcgcgcctttccctgcagttctgaaggaagtggtccctggagctctgtgctcagcggccccagctctttaaagaaaaaacaccctggccgggtgtggtggctcacgcctgtaatcccagcactttgggaggccgaggtgggtggatcacgaggtcaggagttcaagaccagcctggctaagatggtgaaacctcgtctctattaaaaatacaaaaattagccaggcatggtggcaggcacctgtaatcccagctactcgggaggctgaggcaggagaattgcttgaactctgcagggcggaggttgcagtgagccgagattgcaccactgcactccagcctgggcaacagagtgagactccgtttcaataaaaaaaaaaaaaaaagaaagaaaggaaaaaacaccctggaaatcagaggaattgcatttttagaattgaagcctgagaccagagagggtgtgacctgtggctgagagcaacgcgggccagatcccagattagccaggtccggatgccaggcagcccctccctggaccagcacgcccgtccggtgactcgtccctaagcctcgtgctgacaaggagggtgagcaggctgcggggaggggtcagagctgtgtggagtcaaccagcctgctcttcccatggcctgtgcttcccccgccccagcccctccagccaggtcacccctcccagccagaggatgggcacctgagtacagctgccagccagggacaggcttcaggctgcctccaccctgcccttcttcttctctccctctttcctccccaccctcttcctccctcctttcttcaggcattcacagacagggctgcccacaaggctgcagatcctcaagaaccaaagggaaattcctgcctgcttgtctcttccaaaaagccgctcgcaaagacagacatctacaaacatctacagtaaaaagatgaatagtgtaaaaaataacaacttcctgttccattctccacttgagacaaacgggactgcatggtttgttgcatgtgggcactgcacttccttcctgtggtccccccacctgccacgggagtgtccctctccctcatctcctggatccccgagggacgcagggctcccctctgcacttcttcaggcctctcatcttagttcctgctggccgtcagctcacttgtccagggcacccggttctgttgcccagcctggcacctgatactagcagttctcaatgaatactgagaatgacgtgaatatgaaaaattgtaggctctatgcttgcctccgatgtcccaggggcctggcaaatggcagaaggtgggtagttccccccctccttttttttttttgagacagggtctcactctgttgctcaggctggagtgcagtgacacagtcatagctcactacagccttgacctcctgggctcaagtgatccttccacctcagttcagccttctgagtagctgagactataagggtgcatcaccatgcctggataattaaaaaaaattttttttgtagagtcagggtcttactatgttgcccaggttgtccatgccttttaaccccaggcagtaccttaggagcccaacctaggagctgctaacggctccaaggactgcaggatctcctgaggatcatggcagaagtcagggacttaagggacccgaagagtctgctccccttgaaaagggagcaagagcagcatctctgtgcaaaggaagcctggagaagcagcagcccagccctcctctcatgcttgcttgagggttgcccttgcagctgcgtcaggtgctgagcaggctgtggggaagaggacaccagcccctcctgttctctgcttacaggctgaggagaaggcagctgtgtaagctgaccacatactacacattggggaagggacaggtgggtggtcagaggaggccttgacccaggcaggtgctgtcagaagcggcttcccccaggaagtgacgatcatttgaatcctggagcactggggggaatgggggagggagaacattctaggcacagtgaatactatgtacaggggcatggctatgtgagagaccagggtgaactcaggaacagataagggtgttcagagcacaggagaccaggaggttggcagcaccaggccctgggggccttgttgaccaacccaaggaatttgaagttgctgcagacagtgatgcgtggcagcactggtggatgaattggccttttctcctttcccccaacactccagggtcattcctgcctgaggactcctgccctcagagctctcctggggcttttatttattttgttttgagacagaatgtggctctgttgcccaggcttgagtgcagtggtgtgatcttggctcactgcaacctctgcctcccaggttcaagcgattctcctgcctcagcctcccgagtagctgggactacagacgtgcgccaccacgcctggctaatttgttgtattttagcagagatgtggtttcactgtgttgcccaggttggtcttgaactcctgaaggcaatccacctgcctcggcctcctgaagtgttgggattacaggcgtgagccacctcgccggcctctcctggggctttgaacgcctgcctccctcctctcatttgggtctcaggtcacccgcctgcctctgagttcacccctgaccacctagactctgcctgttccatcatctttgttccatctctgcctgttccatcatctcggcaagatccggtatttccttatgtgtttatggcctacttctcctcactggaatgtaaactcttagaaagcagagatcttatctatcttgttcacctatgcatccttggctgttatgaggatcatgggagagcaacaaatatttattgaggaaataaaagaacaaggtaataaagccagaacaaagtggtggcagtggagatggattcaagaaatactgagaggccgggcatggtggctcacacctgtaatctcagcactttgggaggccagctgggaggatcacttgtggccaggagttcgagatcagtctgggcaacatagcaagatctcctctctgcaaaaaatttaaaaaacattagctgggagtggtggtgcacacctgtagtccctagctacttgggaggctgaggcaagaggatctcttgagcccaggagttcgaggttacggtgagctgattgccactgccctccagtcagggtgacaaagataccctaactcaaagaaatattgaggaagtagaatcttttccacctgttgtagtagggcgtaagggagcggtgcaggcatcccaggtttctggctagggttgtgggtgagcagaggggacagttactgggcgcagcggcacagaaagaatgagcagtcgatgcttggcggtgcccagcccagtggctgaacttagtgacatccaagctgcagtctggctgaaatcactaacctgaaagtggtatggagaaagtttgtttgaccctgactcagtgcctctccccgggccaaccctaccgtgttacctaggagctccccctttgtctttataaatgagataaaagtaaccagacctccctggaaaaaccgaggagcacttgcttctctggtgactgcggggcctaactgcagggttcacaaagggctgctggtgctgggtgataacatcggaaaggaacagcagttcacaagatggggctgggggactggcccaggaacccctccaggttaaatgatgcctccgggccccgcacttgggacgtctgcaggcactgggagggtttttcccaagccgctggcagcagcgagcggagcctcgcccattgaatcagcatgccctcccggctggctgctgagtcaggcctgcggagccggcgaagccgcaggacttgacccaggcgcgctccgctgcccttcaggccgggctggaggtcgaggccctgcagccagggagatgcgccggtggctgcgtggggacagaggggggttgtctcccaccctcacagtctacaccccggcccttcccctttgcccgtctgaggcgcagtttgtgtcgagggggagcgcctggaaagtttcctcgtacagatacgagggtccaaaagccccgaggagagggaataatgagaaggggagggcgcagggttagaggtcagggtctcgaccaaaggctgtcggttttcctggaggagggagaaaggcctggccgggatcatctgattccggggcctcccgaaggcctcctagctgggttttggggggaccgaaacgagcgcatgaagctcgcgggcctgggagtggggtggggcgggagcccagtggtggcggctgcggccgggcctgcaccgtccccggccgcattctggtagggcccacagtccggctggaagggaagctgccgaagcgctcggtcatcgcggctgcggagtcggagaggccagggcctggccgcccaccccgcgagccgcgccctgccccgagcgccccacccccgtccgcgttacaaccgggaggcccgctgggtcctgcaccgtcaccctcctccctgtgaccgcccacctgatacccaaacaactttctcgcccctccagtccccagctcgccgagcgcttgcggggagccacccagcctcagtttccccagccccgggcggggcgaggggcgatgacgtcatgccggcgcgcggcattgtggggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcggtgagtccccggcgtgcgccccggaccgcggccccctcctcatcctccgccccgtccctgtcccgctcctcttcggacccgccccggccgtaactctgtccccatccaggcctccttcccggtttgggtcccggcccctctccgttcccaccccggtacccgccccagttcaccgccccggccggtccgcgaccccttccaggttcaggtcgggttcttgtccccggcccttttgccagccccggctcccggcgccgcgcgtcctccccatccgcgtcccactgcaggttccggtccccggccctgcccagggccccgccctggccccgcatccccggcttggccctgctgcgggcggcggcggccgttcccggggacagctgtggaccccgggaacccgcgacaggggaggtggctgaccccgggatcgcggcgggcggggaggccggaggcccggcggggctggctttgtccgattcctcctcttccttccacccccgcctctcccggcaccgccctgagcggacgcgcctgtcattctcgcgggcggcggggggccgggtccctcccgagagctggctccgctttgcctccttggcgaccccttattttcagtaaccagatgcgaaacgtttcaggcgaccctgttcacctaggctggcgttgctccaactaaacttgaagcagcctccgtcctggaatgctttttccatgtaaaattgggtgtacccttttccttaagaaaattaaaataaagcgtaaaagtagtgaaattaatgcgtgatggagtggatggttttataacttaacatttgtaggtcatttctaggtatatttgtattagaattgttgctgcctgttactgttttattatttaaatgaattaagaatttacatattaagcgtttgaaaaggaatacttacaaaaatgatgttttttaaaaatgtgagaacaaaaaatttgagatatactatttcaggtgttctgtaaaagggcagttagagctttgattctttgcattagttaaatcccaaggcctttttttttggtacggcatgactaagccattgatcagaatcagctcggaatacattgcactagtttagtgaaagacactttagaaaactggaagaacctcctgaagttatattacagacatggccttgcttctttcagggattgtcagcaagcctgttatggtgagaaatttgacctattgctctgtttcctaaatatttgtaggaatacaatgatactaagtatgaagtatatttcaacttgtatggaattctgtgtgggagggtaggcactctaaagagccagtgtctctccaagtcatcaaagaatgcagcatcatgttgcagttgagcctggcagccctgtctggcactgagtgctgtggaggacccaggtggtaacctctaaccctactgcagccttggcattgtcttagagaaaagcatccagacatgcacaggactctggacagcgtttatctccagcaaggggggagggaatgacactggggagaggcacacagtatcttcagtatttcatagcaaataactgcagtcgtttaaacttacacattttttttttttttgagatggagtctcgctctgtcgcccgggctggagtgtagtggcgcgatctcggctcactgcaagctccgcctcccgggttcacgccattctcctgcctcaacctactgagtagctgggaccacaggcgcccgccaccacgcccggttaattttttgtatttttagtagagatggggtttcaacatgttagccaggttggtcttgatctcctgacctcgtgatccgcccacctcggcctcccaaagtgctgggattacaggcgtgagccaccgcacctggcccaaatttatacatttttaaaatttatacattcttaggcatgtttctcaatgttggaaaaaagtcaatgtgtaactttctgtatagggccataaattatcttaaaacatacttgtataaaaagaaacctaggatagaaaaatcaaaagttgagtgaaatgtatgattagtatcacctgaaaacattctttgtagataagtggaatgttagaaaccagtattttatttttatttatttagagatgagtctcactgtgtggctcaggctagagtgcagtggtgtgatccccgctcactgcaacctccgcctcccaggttccagtgattctcctgcctcagcctccctagtagctgggattacaggtgcccactaccacaccaggctgattttttgtatttttagtagagacggggcttcaccatgttggccaggctggtctcaaactgctgacctcaggcgatccacccgcctcagcctcccaaagtgctagggttacaggtgtgagccattgcacctgggctgaaaccagtattttatgtagcaaagaaatgatcagtaatatactcaagacgagagtatttgggaagatttaagtgtcaaatttcagggcatagaataaaagtgacaagcacattaagattgcaaatactggtcttaaatgtctgttgggaaccaactgaatggcaggtactgtgctgagtagtcagcgataccttgataaaagagccactgttggccgggcgtggtcatgcctgtaatcttaactctttgggaggctgaggctgcagatcgcccctagctctttgggaggccgaggcaggtggatcacctgaggtcaggagtttaagaccagcctggccaacatggtgaaaccccgtccctaccaaaaatacaaaaattagccaggtgtggtggtgcacacctgtaattccagctactcatgaggctgaggaaggagaatcgcttgaaccgggaagtggaggttgtagtgagccgagatcacgtcactgcagtccagccagactccgtctcaaaacaaacaaaaagagccgctgtcagccgtgcagtggctcactcctgtaatcccagcactttgggaggccaagatggaccgatcacctgaggtcaggagtttgagacccgcctggacaacatggtgaaaccctgtctctactaaaaatacaaaaaaaaccaaaaccgggtgtggtggcgggtgcctctaatcgcagctactcagaaggctgaggctggagaatcgcttgaactggggaggcagaggttgcagtgagccgagatcacgccattgcactccagcctgggcaacaagagcaaaactctgcctcaaaaaaaataaaaccaaaaaacaaaaaaactctgtcctctaggagctcacaggctggcatgggcaggtaccacagaccaggttaaaggctgtggagtgcactgaggaggcgattcttcacaaaagaaaagtaccaatcagccagtgtcagggggtcaggggtgggattgggattggggttcctgcttggaggaaataaatcctgaggttgtgctgctgtaaaggggcatgttgggaaggggacatgggagtgagtgtggaaagacgaggttaggaaaggccttgaatgacttcttagaagtctgctttcattctgaggtttacaaaggagggttggaagattttttttttttttgagatggagtcttgctctgtcacccaggctggaacgcagtggcacgacctctgctcactgcagcctctacctcccaggttcaagtgattctcctgcctcagcctcccgagtagctgggactacaggtgcgtgccaccacatccggctaattttttgtatttttagtagagtcggggtttcaccacgttagccaggatggtctccatctcctgacctcgtgatccgcccgccttggcctctcaaagtgctgggattacaggcgtgagccaccgcgcctggccggagggttggaagattctgaggagccagttgccactttagaaagagcataggcagtggtggggcaggtgctgtgaactgggatgaggttaattaggaagccattaaccccaactcggcaagcctcaggattagggcagtgacagaaggaacagagaagctaggtgggggcaggggctgggctgtaagggttatagtggagctgatttggggctgactggattggggtaaatgaggagctgcagggaggactccccagaatgatcctgtgaaaacctgagtcactcctctgttaaagcttttgtcagtgtcctctgagcaccccaccctgtctcttttcatcttcctgctctggccctactcaagcacttccaggtgcatctggagttctgaaccaaacccattcttgtagtgattagcatttcttcacttccccacatactccttagcctctgccctgatttttctccttagcacacctcactatcttaaatgctgtattattattattttttttttattattactttttgagacggagtctcgctctgtcacccaggatggagtgcagtggcatgatctcagctcactgcatcctctgcctcccgggttcaagccattctcctgcctcagcctcccaagtagttgggactacaggcatgtgccaccacacctagctaatttttgtatttttagtagagacaggatttcaccatgttggccaggctggtctcgaactcttgaccttaagtgatccacctgcctcagcctcccaaagtgctgggattacaggcctgagccaccgtgcctggccaatactgtattattttaatcattttaaaatttttattgtttgtctccacttaacattcataacctccacaaggatggggagttttgtctcttgtattcagtgtcggtgcttggcgtgtaataggaacttagtaaatgtttgttgaaggaatgcatctagaatgatcctcatctctaatttgggtgattcactggctggtgacactcatccaaggagggaaaatgggagaaggatgagattatgagtttgtttttggacatgttaaatctgaagtgcttgtggggcagccaagtggactagtgggcagttagagatacatctttggagctcaagacagaggctgaggctggaggtaaagattccagagactgcatcatatcgttgagccagtcgggtgtgatgtccatctggtagagatggggagtgggtctaagaggagagggtcctgggaaaccaagagaagaggagggaggagatcagtagcaaattggctaagaagtcagtgatgggttggactgagaagtctctatggattttgcttctaggaggttactaatgacctttaacttttttttttttaaatatagtttatgtagagacgggggtctcactgtgtttcccaggctggtctcgaattcctgggctcaagccatctgcctgccgtggcctcccaaagtgtcgggattacaggtttgagccactgcacccggcctgttgcctgtttcctgagaatattacctcttaaggatggaggctatttcgagatgatcttcattcgttctcccaaggcatcctttgtggcgttgtactctgtagcctcctagttagtatactcatggatcagaaatgaattatgatttttttttagttttaactaatttttggaggcagatgaaagcagtttgcatatatgctttttgaatttgaaaagtgctatctgaacttaaagcaacggatatggagcaaacatgttaagctgagttacgtgcatacgtgaactgagttacttccttggttctaaaatatctgttaccttcatttaaaccatagattgttccctgacttcagttgcataacataaatttatgttcaggcttctctgaagttcactatgctgctactaaaactgatcagagtgatgtttgcactgttccagagaaaataggtactgtaaaccctgcggatgtcatatgtgtctgtagtttcagttactccgaaggctgaggtgggagaatcagttgagcccaggagttcaaactagcttgggcaatatagtgagaccttgtttcttaaaaaaataaaaggctgtgcttggtggctaatgtctgtaatcccagcactttgggaggctgaggagggcggatcacctgaggtcaggagtttgagaccagcctggccaacatgggtgaaaccttgtctctactaaaaatataaaattagccgcgtgtggtagtatgcttctgtagtcccgggtatttgggaagctgaggtaggagaatcacttgaacccgggaggcggaggttgcagtgagccagatcgagccacggcactccagcctgggcgacagagtgagactcccatctcaaaaagaaaaaaaaaaagtaaaataggtactgttactgagattctactgttgaggaatttgagggtgagagaggggaagtttcagaaaccaaagttacacagctgtgaagtcaagattctaactcagtttttttgcttcgcggtataagctttgaatcaccttgcagtacttaaagctgcagcttcaagtgaatcatgataatgctgtttaatcctatcattactttttcttggggaaacctcgcgccacttcaatttttttcaaagatgtaccattttaaccatttaaaagttcacaattcagtagtgttaaggatatgcacatcgttgttccacatttctggaactctttcatctggcagcgctgagactgtagcccccaaatactgatatctcctcctccctcgccctcccccggtaaccatcttttctactttgtttctatgattttgactactttcaatactttattttttattttttttgagatggagtttcactcttgttgcccaggctggagtgcagtggcacgatctcagctcactgcaacctctgcctcccgagttcaaacaattctcctgctttaatttcctgagtatctgggattacagtcatgggccaccatgccgggctaattttgtatttttagtagagatgggtttctccatgttggtcaggctggtcttgaactcctgacctcaggtgatcaccccccatcggcctcccaaagtgttgggattacaggcgtgagccaccgtgcctggccttgcctgtctttttcatctgagccattctagcggggtatagtggcatcttgttagttttaatgtgcatttcactgatgactcataatggtgagcgcttacatgcttgtcggtctttgtatgcctggatttgtaaagtgtctgttcaagacttttgcccatttaaaaaattggattgtttgtatttttaagttccttacatatttatttatttatttatttttgagatggagtctcctctgttgcccaggcttgagtgcagtggcgcgatctcggctcactgcaagctctgcctcccgggttcacgccattcccctgcctcagcctctggagtagctgggactacaggcgcctgccaccacgcccagctaatttttttttttgttgtatttttattagatatgggtttcaccatgttagccaggatggtctcgatctcctgacctcgtgatccgcccgtcttggcctcccaaagtgctggtattaacaggcgtgagccaccacgcccagcagttccttacatgttttttttttttcagatggagtcttgctcttgctctattgcccaggctgacgtattttttatacaagccgtttgccagatatatatgtgtcgcaaatattttttcctaatctatggcttaactttattttttggtagtgccttttaataaatcaatacttttaatttttcttaaccatgctctggcaagttttattaaagaaattttcggctgggcgcggtggctcacacctataatcccagcactttcggaggccgaggcgggtggatcatgaagtcaggagtttgagactaccctggccagtatggtgaaaccccgtctctactaaaattacaaaaattcgccaggcgtggtggtgtgcacctgtagtcccagctacttgggaggctgaggcagaagaatcgcttgatcccgggaggcagaggttgcagtgagtcgagattgcgacactgcattccagcctgggcaacagagtgagactctgtttcaaaaaaaaaaaagaaattttcgcagggtttatttttatcttttattttttgttgttgcctaagcaacatccgctttccttaattctgaaagcatatctataaataagtcacccaaaggccaaatagatgcatttgttttgtctggttgttaatgttttctttttaaaaaaatatttatgtatttatttaatttttgagacaggatcttgctctgttgcctaggttggagtgcagtgtcacagtcgtggctcagtgcagcctcgtgttcaagtgatcgtcccacctcagcccctgaagtagctgggactacatgtgcgcaccaccatgaccggcttgttttttgtagagacagggtttcatggcattgccctggctagtctttaacttctgggctcaaatgatctgctctccttggcctcccaaagtgctgggattacagacgtaagccactatgctgggccaccaagatactatttatttccctgaatatgacgtggactgttcctgtaggctggtcccttcacctcaggaccctctttgctggtattgtttggggcttctgcgcctgtatatggggatgggacctgaccctgctgatctggccagcactgccagggtttcctgttgcccatctctcggtaaaacatcccttataaacctttgcaaggaaaaaacctctgttttcttccctccatcccatttttccttaatgtgctaccctcgtctgtattcataggaactttatttaacacttgagaactgagagtaattgacatttctttcttggctgtccttcattctgtgcacccagacctattgctttttctaccacattctttttctcttttagaaaattgaaatgtaagtcacatcacatcaaatgccccattttaaagcgtgcagtgcagtgatttttaatgtattctctgttttgtgcaactaccatctatctaattccacacattccttttccctttttagtgcttggtgttttttttttttcttaactttcttcatcactgtaagctttccccacctggctgaatttcacatgataaaaccaggggaggtaaagtgaccaaagatgatgccctttgcttctctggcctttgctttcatttcattaatttttttttttttttttttttttgagtcagagtctcgctctgtcacccaggctggagtctgggtgtatatgtatgaacacagtggggtgtgtgggtgtgtgtgaacatagtggtgtgtatgtatgaacacagtgggggtgtgtgtgcgtgagcacagtggtgtgtgtatgtatgaacataggggtgtgtgtgagcacagtggtgcatatgtatgaacatagggtgtatgtgtgtgagcacaagggtgtgtgtgtgtgtgtgcgtgcatgcagagtggtagggttcctgaagcagagggacacttggggcaaagagaccttggattgtgttcttcttgttggtagaataagcttaaatcacttcatgtatcccagtttcctcagctgtaaatgggaattataatgataggtcatcaaactacctgcagactttttttgttgttatttcgataaaatattacacatttgaaaatgctcccaaaactaacatattggacagatgcgaattcttctttccttttttttgagatggagtcttgctctgttgtccaggctggagtacagtggcatgatcttggctcattgcagcctcagcctcccaagtagctggaactacaggcatgtgccaccacgcctagctaatttttatatttttagtagagatggggtttcaccatgttggccaggctggtcttgaactcctgacctcaagtgatccgcctgcctcagcctcccaaagtgttgggattacaggtgtgagccaccacgcctggctctttcttgtcttttacttatttatttttttgtgacagggtttcgctgtgtcacctaggctggagtatagtggtacagccaaagcttactgtagccttgagctcccaggctcaaacaatcctcccaccttagcctcctgagtagctgggaccacaggcgtgtgccaccacacccaactaatttttatttttgtagagacagggtctcactgtattccccaggctggtcttgaactcctgggctcaagcagtgctcctgtcttggcctcccaaagtgctgggattactggtatgagccaccacacccggcccagatgtgaattctttatttttattttattatttttgagacagggtctcaactctgtcacccaggctagagcacaatggtgcaatcatgtttcactgcagccttgatttcctggactccagtgatacacctcagcctcctgagtagctgggaccacaggtgcatgtcaccacacccagctaattttggtatttttttttaggatggggttttgccatgtttccctgtctggctttgaaatcctgagctcaagagatccacccgccttggcctcccaaagtgctgggattacaggcgtgagccactgagtcaggctgtgaattctttcttttattttctttatttttgagacagagtttcgctctgttgtggagtgcagtggcacgatcttggctcactgcaaactccactttccaggttcatgcgattctactgcctcaccctcccgagtagctgggattacaggtgtgcaccactatgcctggctaattttgtatttttaatagagacagggtttcaccatgttgaccaggctggtctcgatctcctgacttcaggtgatcgacccaccttggcctcccaaaattctgggattacaggcatgagccactgcccctggcctgtgaattcttttttttttgagacagagtctcgcgctgtcgcccaggctggagtgcagtggcgcgatctctgctcactgcaagcgtcacctcccgggttcacgccattctcctgcctcagcctcctgagtagctgggaccacaggcgcccgccaccacgcctggctaattttttgtatttttggtagagatggggtttcaccgtgttaaccaggatggtctcgatctcctgaccttgtgatctgcccgcctcggcctcccaaagtgctgggattacaggcgtgagccaccgcgcccggccctgtgaattcttaatatacatattgtatgtatacttttttggttttgtttttatcaagttatatatgtattttgtatttatgtgtagatttgaaaataaacttttaattttagaatagttacagatttacagaaaagttgcaaagatagtacagagagttcccacatactttgcatccaatttcccctaatgttaatatcctacattactgtgatacatttgtgacaaccaaggaaccaacattggtaccttactattattattactattattttttttttcttttgagacaaagttttgctaggtcacccaggctggagtgcagtggctccatggctcactgcaacctctgccttctgggttccagcaattctcctgcctcagcctccctagtagctggaattacaggcatgcgctactatgcctggctaatttttgtacttttagtagagatggggttttgccatgttggccatgctggtctcgaactcctgcccttaagtgatccacctgcctcggcctcccagtgttgggatcacaggtgtgagtcactgtgcccagcctggtacattattattaactgaactccactttatttggtatcactggtttttcccttgtccttgttgtacctcaggatcccatccaagataccatatcacatttagtcatcatgcctcctgctctgtggctgttttcttagactttccttgcattagaggactgtcttagcttgcgaggctgtaacaaagtaccacaggctagtgactcacgaacaacacaagccacagtcctggaggctggaagtctgggatcagggtgccagcatggtcagattctggtgcagaccctctttctggttgcatgctaccgacttctagatgtattctcacatggtgaaaagagtgtgagagagttccctttttaaaaaaaatttaataataattatttttttgagacagagtctgtctctgttgcccaagctggagtgcagtggcacaatcttggctcactgcagcctccgcctcctgggtgcacttcatcctcccacctccacctcagcctcccaggctcaattcatcctcccaagtagctgggactacaggtgcacactacaacacccagataatttttgtattttttgtagagatggggttttaccatgttgcccagactggtcttgaacacctgagctcaagctatctgcctgccttggcatcccaaagtgttgggattataggtatcagccactatactctgcctaggttccctttattttttatttttttgagacagagtctcactccatcgcccaggctggagtgcagtggcatgatctcagctcactgcaacctctgcctgctgggttcaagctattctcctgcctcagcctcctgagtagctgggattacaggcatgcaccaccatgcccggctaattttgtatttttagtagagacggggtttcaccatattgactaggctggtctcgaactcctgatttcaggtgattcacccacctcggcctcccagagtgctgggattacaggcatgagccactgctcagcccctgggttcccttttttaaaggcactaatcccaccgtgaggggtcccctcatggcctaatcacctcccaaaggccccacctcctaaaagcattactctaggcattagaattttaacatgtgaattggggtggggggcacacattgattccattgcaataaccttgatagttttgagacatatgggcaaggtattttgtacaatgtccttaaatttgggtttgtcttgatatttttcccatggttaagtcagggttatgagtttttaggagaaagactactggctcccagttttggattctgattccattgtaccaaaacaaatcagaactctttggagtaatgggtgattctagggctggggcagggaaaatataagatgagcctgaagcttcttctagtgtttgaatgtaaggatatgctaaaaaacaaagggatgggaacatgaagaagggacacaggaaccaactgaaagagctcccattgacaaaagctggaacaacttgaacaataaaataaataatgtagttttttggttttttggttttttttttttttttgagacggagtctcactctgttgcccaggctggagtgcagtggcgtgatctcggctcactgcaacctccacctcccaggttcaaggcaattctcctgtctcagcctcctgagttgctgggacaacaggcgcacaccaccacgcccggctaatttttttgtatttttagtagagacggggtttcaccattttggtcaggttggtctccaactcctgacctcaggtaatccacccaccatggcctcccaaagtgttgggattacaggcatgagcctccatgcccagccaagaatgtatttttaacaattagtattttacttatcacctaaagtataaaacaaatatctgtaagtccatattgatataaataattacattaataaatgaggaaagagacaaagaatagactgatctcccttagagaagaattccaaataatggtagattcttccatcttccagagggtcctctataactttccccatctccttggagtgtgggctgcacttagtgacttgcttcctaagagtatggaatgggatgactgtgtgtggaggtggtggtgataatcttacagtggctaaacctgcaaatgctacctgagccaggtggtcgaggctgatgtattaggtgtaaatcatgttggcacgtgcccttgatagaattgttatgaaaagattcaaaccctgtaaaatatttgaaaagatttattctgagccaaatatgagtgaccatggcccgtgacacagccctcaggaagtcctgagaacatgtgcccaaggtggtcggggcacagcttggttttatacattttagagaggcatgagacatcaatcagatacatttaagaaatacattggttgaccgggcatggtggctcacgcctgtaatcccaacactttggaaggccaaggcaggcagatcacttgaggtcaagagttccagaccagcctggccaatatggtgaaactccgtctctactaaaaatacaaaaattagcctggcgtggtggtgcatgcctgtaatcccagctactcgggaggctgagtcaggagaatcacttgagcgcagaaggtggaggttgcctggcccgaaggcatttgtttaatttccttttgcttccaatgtggctgttaagaaacctaaagttggctgggcacggtggctcacgcctgtaatcccagcactttgagaggccgaggcaggcagatcacgaggtcaggagatcgagaccatcctgggtaacatggtgaaaccccatctctactaaaaatacaaaaaattagctgggtgtggttgcgggcgcctgtggtctcagctaccagggaggatgaggcaggagaatggcctgaacctgggaggcggagcttgcagtgagccgtgattgcaccactgcacatcagcctgggcaacagagcgagactctgtctcaaaaaaaaaaaaaaaaaaagcctaaagttattctcgattctttctacgtgactttttttttttgagatggaatctcgctttgtcgcccaggctggagtgcagtggcgtgatctcggctcactgcaacctccgcctcccgagttcaagcaattctctgcctcagcttcccgagtagctgggattacaggctcccgccaccacacccggctaatttttttgtgtttttagtagagatgggctttcatcatattggccagactggtcttgaactcctgacctcctgatccacccgcttcagcctcccgaagtgcttggactaaggcgtgagccaccgcgcccggcctgcatgacctgttttttttcctccctctctggaagtatagagaatattctctgggactgggtgtggtagctcacgcctataatcccagtactttgggaggccgaggtaggaggatcacttgagcccaggactttgagaccattctgggcaacatagtgagaccctgtctctacttaaaaagaaaagagaagagaagaaaaagaatattctcttgtcaccaaaatattttaattttcttaggacaatttttttggggggtcaagttctacctttagaacagtgccttgaataaagtagaggctcagtaaacatttgaggaatggatggatgttactcttttggggctggccagatttctttctttagttctgttcttttctgttctattctgttcttttccttttcttttctttctctctctctttctttctttttctttgagtttctttcttgttgcccaggctggagtgcaatggggtgatcttggctcactgcaacctccgcctcctgggttcaagtgattctcctgcctcagcctctcaagtaactggggttacaggcatgtgccaccacacctggctaattttgtatttgtagtagagtcggggtttctccatgtttgctaggctggtctcgaactcccgacctcaggtgatccgcccgcctcggcctcccaaagtgctgggactacaggcgggagccactgcgcctggcctggggctggccagatttctcgggaaaatttgcctgtcttttttttggaggcgaagacctagctgccctaccaggtctacaaaccaagtggtggctgagagttggtcatctcccaggttccccctggtgctgcctagctcagttcttctgcagctccctgccatgcttgtagtggacatcgcagtcgcacttcttagtttaaagcatccacctaatgcagttgtgtgtgtgttatgctgaacgttgaggatgtgttttgaggaatgcatcgttaagtgatttcgttgtgggggcatcagggagtacatttacacaaacctaggaagtataacctactgcacacctaggctgtatggtgtagcccattgctcctaggctaaaaacccatacagtatgtggctgtggtaggcagctgtaacagtggtaaatatttgtgcaactaaacatatctaaacatagaaaagatatagtcaaaataggtgttacaatcctttttttttttttgagacagagtctcgctctgttgcccaggctggagtgcagtggcacaatctcagctcactgcaagttccgccttctgggttcatgccattcttctgcctcagcctcccgagtagctgggactacaggcacccgccaccatgcccagctaatttttttgtatttttagtagagacagggtttcatcgtgttagccaggatggtcttgatctcctgacatcgtgatccaccagcctcagcctcccaaagtgctgggattacgggcatgagccaccatgcctggcctggtgttataatcttatgggaccactgtcaaatatgaggtccctcattgaccaaaatgtcattatactgcacatgactgtattgtacagaatttgtctattgtaaatttgttagtttgcgtcatatctatcagggagttagttaaaattcccaaggccttctcttttagtcattagtgtgacagagtaagtaaaatatcactcctgtcataaaggacgaattaaaaggacagttttagtgtgtaatgagaactattttctgagacagtcttgcttgctctgtcacctacgctggagtgcagtggcatgatcatagctcacgcagccttgaactcctgggctcaagccatcttcccacttcagcctctcaagtagttgggagtacaggcacatactaccatgcccatctaatttttaattttttaattaaaatattatatgtatgcatatatatgtgtatatatacatatttcagacaaggtctcactctgtcacccaggctgaagtgcagtggcacagtcatggctcactgcagccgtgaactgcagacatgcatctttatgcctagctaattttttttctttcttttttttctttttgaaaagatgggacccctctatgttgcccagtctggtcttgaacccctgggctcaaacgatgtttctgcttcagcctcccaagtagctgggagtacaagcatgtgccaccatgcctagctaattttttttgtttttttgtagagatggggtcttgctgtcttgcctaggctggtcttgaattcctgggttcaagggatcctcccacctcatcctcccaaagtgctggggttacacacatcagccacagtgtccagcataagaactatttctatttttcatattacctctgcttggattactttagaggtaaagcaactgaatatacaaattcatatttatgtctggtgtttttgtcagagctgagtggtagaactttcgttgtagtctgtatattaggttttattgcatgccatctcttttcagttacacgggtacaaatccttacctgtcaagtaggatgttgaataatacaaacatgctacagttaccttgtctatccgaactgttaagccttatttcaagtttgagcatgggttttttatttactttctttatccagaaactttttttttatttttatttttttgagacggagtgttgctctgtcacccaggctggagtgcagtggcaggatctcggcttactgcaacctccactttccaggttcaagcgattctcctgcctcagcctcctgagtagctgagactacaggtgtgtgccaccacacccagctaatttttgtatttttttttttactagagatggggttttgccatgttgaccaggctggtcttgaactcctgacctcaagtaatccgcctgcctgggcctcccaaagtggtgggattacagggagagccactgtgccttacccagaaacttttttgttattgtttcttatatttccaaaaggcaggtaagccttttgaaaggatggcatggccaggcatggtggctcacgcctgtaatcccaacactttgggaagccaaggtgggcagatcccaaggtcaagagatcaagaccatcctggcatacatggtaaaaccccatctctactaaaaatacaaaaattagctgagcatggtggtgtgttcctgtagttctagctacttgggaggctgaggcaggagaatcgcttgaacctgggaggtggaggttgcattgagccgagattgtgcaactgcactccagcctggcgacagagcaagactccatctcaaaaaaaaaaaaaaagaatagcatttcctaatttctgtcccagtgggtagtttgtaaaagaccaggtctatttgtattgggtttttttttcttttgagacggagtctcgctcttttggcaggctggagtgcagtggcgcgatctcggctcactgcaacctctgcctcccagattcaagcaattcttctgcctcaagctcccgagtagctgggactacaggtgcacgccaccacgcctggctaatttttgtatttttattagagacggggtttcaccatgttggccaggatggtctcaatctcttgacctcgtgatttgcctgccttggcctcccaaagtgctgggattacaggcgtgagccaccgcgcccagcctgtattgtttttcaaatgacattttaaaaagagtaaaaattgttttatttctaggttacaaaatgctacagacaggattttaacatttattttgatttattttttactcctggcaagttgcgatacaggtatttaatcagaggtcccaatgtggagcctgacaggataggttcttaacattctcaatttatgtcctcagaatgtggtagtacgaaagaatgattgaagtaaatctttggacttgagacttgtggcctggcatggtggctcatgcctgtaatcgcagcactttcggagggtgaagtggacaggtcacttgagcctaggagttgaaggccagcctcggcaacatggcaagaccctctctacagaaaataaaaagaaaataaaaaagaaagaaaaattagccaggcttggcggcacgcacctgtagtcccaactacgtgggagactgaggtgggaggatcacttgagcccaggaggtggaggttgtaatgagccaagatcatgccactgcacttcagcctgggtgacagagtgagaccctgtctcagacaaaaaaggagaatcatgtatgttaaaaatacatgtcaaaatggcacagtgggctgggtgcagtggctcatgcctgtaatcccagttctttgggaggccgaggcgggcagatcacctgagctcaggagtttgagaccagcctgggcaacatggcgaaactgtgtctctactaaaaatacaaaagttagctgggtatggtggtgcatgcctgtagtcccagctacttgggaggctgatgtgggaggatcgcttgagcccgggatgcggaagttgcagtgagccaaaatagtgccattgcagcccaccctgggtgatagaatgagagcctgtcttaaaaaaaaacaaagaaacagtacagtgacaattgcctatactcctagctccttgggagactgaaggtggggaattgcttgagtctaggagtgcaagtccagcctgggcaacatagcaagaccccatctctaaaagaaagagaaaaacatgaaaaccacaatactatataattgcaaaagttgagtcactatctaaaataatgtaaacaaaatgagttctaaaataaaaataacaattatagggtttttttggtcttcattatgttaggtagtgacttacagtctgtagacacagtacataatttgttaggggcctggtgtgatagctcatacccatatctccagcactttgggaggccaaggtgggaggatcactggagcccaagagttttagaccagcctgggcaacatggtgagacctcatctcaaaaaaaaaaaaaaaaaaaaaagaatttgttaggtttacttgaatcctgagactttaaatttagtagactgtaatagctttgcctgttgaacaatagccttaaagaggtttgaccctaaaaagggcttcttatgtgttttttttttttttcgagacggagtctcgctctgtcgcccaggctggagtgcagtggcgccatctcggctcactgcaagcttcgtctcccgggttcacgccattctcctgcctcagcctccggagtagctgggactacaggcgcccaccatcgcgcccggctaattttttgtatttttagtagagacggggtttcaccgtgttagccagggtggtctcgatctcctgacctcgtgatccgcccgcctccacctcccaaagtgctgggattacaggcgtgagccaccgtgcccggcagcttcttgtgttttgggagcttaattcagatgttagatttatcaggttttacactggagattttgcattgagttcttttggtctcacggagtaaataatggaactttaaataggactttttttttttaaggaataaaagcataataaaaaaagttcatagttagaataacctggggccagatagcttgtgtgtcagtcagagggaaagagggaagggagtatttctgagcctgtactattgttccaggtcaggtgggtatcaatttcacttgacgtacagggagactgagcctccaccacaccccagggtaggtgagaagaagatgcattagctccaaagctgcttcattcattcattgcacacatctttattgcatgcccgtgggttgctaggcattgttttggctgattccttgttccattgaatcatctccaggcatacacggcatgagagttggaagatggtccagtgatggtgtgatttataggctggcaaaatgtttgagtcaacttagatactgagtaatttttaccttgcagaaatcagtaaatcagtgttacctgttacttagcggtagcctgtatactttttttttttttttttgagatggagtctcactcttgcccaggctggagtgcagtggtgcgatctcagctcactgcaacctctgcctaccgggttcaagcgattcttctacctcaacctcccgagtagctgggattgcaggcacctgccaccacgcctggctaattttttgtatttttagtagagacggggtttcaccatgttggccaggcttgtctggaactcctgacctaagtgatctgcttacctgggcctcccaaagtgctgggattacaggcgtgaaccaccaagcccagccgcctgtatacttttgaattcttcatcttgaggagctgcaagatagttttccctcagaaacgcattttgtttctgcatcaaacttgaaaaatgtcctaagtagacttgtcagtcgtttacagttttataccttatttatttatttatttagtgatggagtcttgctctgtcgcccaggctggagtgcagtggtgagatctccgctcactgcaacctccacctcctgagttcaagtgattctcctgcctcagcctccataatagctgggattacaggtgtgcaccaccacgcccggctaattttttgtatttttagtagaaacgggtttcaccatgttggccaggctggtcttgaactcttgacctcgtgatccgccagcctcggcctcccagagtgctaggattacaggcgtcggccaccgcgcccagcttgccattacttttattcatagaatgatctttagtttgacctacgtgcatatagacttttgcctgtatttccttctagtttcttggtttttttttaatttagttattaatctggaattcatgttagtatatagtgagtgtaggagtttaactttattttatttttcctaaatagccagttgccttggcaccgtttattatataagctgtctttggttataatggcttagcctagaaatggtgagaggtatcgagtctaaatatacatgccgctgtctgtttccctctgaagaagtggcacgtgtacttaacatctataccatggtcacctggggggcaggtttcttgtgctctcactccgtgctgctcctctagccttggtactgggtctggctttgcagtgatgagcagctgctcaccagcagtgggtgccgtcacacctctgcctcagctcccctttgctgccgggctggcagtgcccttagcaatcttagtagcccttactagccttgagaggtgctacttgataacactggcttcccttgggagtggtttcttctgtctggccttcgtctctcagttggccattgccccccaccaccgtgttccgccacacagccactgtccctgagccttcaggtctttgtgcacctgcttgtgtagcttgtcttctgctagcttgcatgtccccaagggcgaggcccttattaatctgtacattccagggcttagctcagagtaagttttagtaaaacacttgcatctgctagtttgggaaacataaaagaatatatgttgcatcatttggatataatacataaatactttgctgtcagggtggaaaaacaggccttaagttttattttcctcctcctgaagacccttcccttcagtcataggaacctcaaagatgttcagatcaacactttaacctagtacattttaatcttgtttgttgaaaactggtccttaagtgttttctttcactcattttacaaatgtgtattgagtgccaggccggggatatatcatggaacagtatggatgaggtccctagtggagcagcagtatcactcagcaatatattcccagcctggcacaccatggatttgctacagtgaagctggagagccctgtgttaaataaatactaacagttaacatactgtcaggtagaggagtggcctttgttcttttttttttttgagacagaatcttcctctgttgcccaggctggagtgcagtggcgcgatctcggctcactgcaactcctgcctcctggcttcaagcgattctcctgcctcagcctcctgagtagctgggagtacaggcgagcgccatcaggctcggctgatttttgtatttttagtagagacgggggtttcaccatattggccaggctggtctcgaactcttgacctcgtgatctgcccgccttcgcctcccaaagtgctgggattacaggcatgagccaccgtgcccggtcggcgtttgttgttttgttgttttctggcctctttgttagtggagtggaggtggatttctgaatagtcttacagacaacttccaaattttaaaaggaattcagtcttcatatgtatggaaaaagaaaatcatttttccagtgtgtgatgcagagactaacgtgaccctattctcaagcactcatagcttcaccccaaaatcctggaatatatagtctgtatctgctgattcagcttttcttcccttcatgcagcgtctgtcagtccatccattcactacatggactttctgggccaggagctgcctctagaagctgtggagtcctacaagatcaagtccctgccttttttctttttttgggaattttttaaagagacagggtcttgctccgtcacccaggctagagtgcagaggtaccatcatagctgactgtcacctcaaattcctggactcaagcgatccttgtgcctcactgagcctcctgggtagcaaggaatacctgcacataccacccagctaattttacttcatttatttttatttatttatttaggcagagtctcgctctgtcacccaggctggagtgcagtagtgagatcttggctcactgcaacctctgcctcccgggctcaagtgattctcgtgcctcagccccctgagtagctgggaccacaggcgtgtgccagcacactcacctaatttttgtatttttagttgagacagggtttcgccgtgttggccggctggttttgaactcctgccatcaagtgatccgcctgccttggcctcccaaagtgctggaattataggaatgagccaccatgcctggctgtcctgcctttttaaataagagcttatattcaaggtgacattagacacttaatgaatcgtgagattttagacagtggcagtgctgtgaaggaaataactctgacgtgtaatcttgcctccatccctgtcactgtgccgaaaaagatcactgctcactatctttctgttttttaaacttaactatgggtttttaagacttagaaaaaaggagagaggctagcagagggaaccattgctcagtgacagcggctgtcaggcacaacagcacaaatgatgctgtttttatattcccctttcctcccccttttctttctcactttggtgtttgaaagccccttccagacattgcatcacatcaccctgggcctggccctggtggtgcttcgctgtgccatcctcatctgtgagcctgcccggtgaccgtgctgcacctgtccttgatgccctgtgtcttccaggtctgctcctcccctgctgctcttcctgttccatgttctttggctggtttttctttcttcttccagctgtgtgactccttttcaagcctttgtccagttaaacattttaccaagaatgtagtgttcttcctgcatttcattaggaagagaaaaaggcttgcaaacattctgagaaaaaatgttgttcaccgaggctatgtgttttggaaatgccatttagatgttttgctgcttttaatctttggcattaatttcagttgctgtcataaaaaagaattaagacataaaccagaaaagtaattaaatgtgtctgcaaaggaaaaacagaaactgcagaatatggtatttcaaggtcataaattacaaatgtgcatatttattattcccctataaaatgttaattaaaaaattttcatatttacttgatgtaacagaaatgaaacctgtaatgagggatctaatttctttttcttttttcattccagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaatgactcagacgttatcaggaacttttgatggtaaaatggagacttgtttgaaataagcagtttcactaaagaagaggaaagatgattatagaataacagatccaggccgagtgcggtgtggctcaggcctgtaatccaagcactttgggaggctgaggcaggtggatcacttgaggtcaggagtttgagaccagcctggccaacatagcgaaaccctgactctactaaaaatacaaaaattagccgggcctggtggctggcgtgtgtaatccagctactaggcaggcttgaggcaggagaatcacttgaacctgggaggcagaggttgcagggagccaaaattgcatcactgcactccagcctgggtgacagagcgagactttttctcaaagaaaaaacaaaacaaaacagatcatgtgttctgtatgttaataaattactattgatttgggcctatcagaattgtattgattgattgattgagatggagttttgctcttgctgcccaggctggagtgcagtgatgcagtctcggctcactgcatcctctgcctcctgggctcaaatgattctcctgcctcagcctcccaagtagctgggattacaggcatgggccaccacacctggctaattttgtatttttagtagagacagggtttctccatgttggttaggctggtcttgaactcccaacctcacgtgatccacctgcctcagcaaagtgttgggattacaggcgcgagccaccatgcccggcctctgaattttatttttatttttatttttttgagacagtgtttgctctcgccgcccaggctggagtgcaatggctcaatctcagatcactgcaacctctgtcccccgggttcaagtgattctcctgcctcagcctcccaagtagctgggattacaggcacataccaccattcctggctaattttttgtatttttagtagaaactaaaatgttggccaggctggtcttgaactcctgacctcagggcctctctgaattttgaaaagcggatccaaaatagtggatactgctgtgtatcatttaggatttgatttggctgccagtatcaaaaaaacaaaaacagtggcttaaaccacaagatgtttgtcaaataagtactgaggtacactctcctggacgggttctgtagctacacagtcatcggggatactcaggttcctaacatctgccacactgcaccttggcagcctgtcttggggactgagagtgagctccatgtggccctgttctagcataggggaagggaaaggaaggacgtgcctccttccttgaaggctgctgctttgatgatgtgtacagcagtgcttacattgcattggccagaccttatggctgtacctgggtgagtgggagactggggaatgttgtcttcccacttacagtggcaggtccttaagcctaaggaaggagaatggacactggccagtgggtgatggtctctgcaatcccagggccagattgcttcatatctttgactaacctttgtttctataatatcatgcttgacatagagatgaaaacactggaaacatctaggtttttaaatactctctcctgataacttctggctctgtcagcatatcttaggtaaaattaaatataccaaagctttgcttctttcttagcattctctagtttagtgagtgaatagagcagaagaggggctgctggccagcggtttctgctttcatagaggaagtgactgcccacaccctgattttagagtcttcatcctaaccatgttacagccttgagttgcagaactgtagctctgtttggatattgtgaacgtattatttctcaagttctgttaccttgagaacaggtgacatgaatttaaacttgcttttttggtgtcgcagataagagttttaaaaaaagaaggaagaaaaggtcccaccttctggagtttcaggttttaaacctaggaggataataacctggttattatgttatgagagggatgggcagatgtatgttctaaagagagaacagattgctgccagccagctcctagctgtttgtgctcttatgctcctaggaacttgccacagcctcacgctggtctgttccagaaaccagtgagcactctgtaggcagagccctggagtggcccctggattttatgacataaacataagcttatgagtgcaccagtgcattcttactcttggtggtagctacagagatgtcttctctcaccttggaacatcaaggaagatttgtatgtgcactgttctctgacccccacttgcagcccttcaccaacatgcactctgtgcgcagacatgcatgtgtgtacacgaggtcttacacatgggaaagggtctataaaaaattatgttgggcccatcttgatagaaagtaaaataatacagtttcatcagaagggtagctgtgttttcattgctagttcatttggcatgctcttcaaaaaaataagtatttttttgtaggcattctgagcgtgtgatattctttatcataccctgctttgtagtctgtggctgaaggggaaaagagaagtaaatggcagattgtacttatatgtactttggagaaaatatctgcgagtgtaagctacagccccagccacagaatgttcgcacgggtgggagggactcttgctggacaacgtgccacagtgctgcacacgtttctgtctgctcaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgtgagtggctctgtagcaaatgtggtgctaatgtttaaaatggagtcactgggaaagtcatagaggttctgtttgccatattcttttcatattagaacatattagaacattagaacatgcaaaaatgttttgtaaatataagccacaatccagagagacaccattaccttcaacaaggtctgccccgaggtctgtcccgaggtctgccccagcttaggctctggagcttccttgcccctctgtagcttggcttccatgccatcagctgctggtctagcagtggtccaatctggccgtctgaatttggactctgggcaacctctctgccccttagggtgggtgctcttggcattgccattctctttgaaactcccctggccctctggacaccacctggctctcttgccgcctctctcatcctccccttggcttcccttgccagcttatctttctgtatctgcaggggaagaaacgatcttggttttcttcttcttcttttttttacaaggagtctcgctctgtcactcaggctggagtgcaatggcacaatcttggcttactgcaacctccatctcccgggttcatgtgattctcctgcctcagcctctggagtagctgggattacaggtgtgtgacaccatgcccagctaagttttttttttttttttttttttttttagtagagatgaggtttcactgttttggccaggctggtcttgaactcctggcctcaagtgatctgcccacctcagcctcccaaagtgctggtattccaggtgggagccaccatgcccagccttctttctctgttggctctatttggatgtttatcctagtctcagttatttttcattcaacatttatttctgattcagttaactttttttttttttttttttgagatggagtctcactctgtcacccaggctggagtgcagtggcacgatcttggctcactgcaacctccacctcccgggctccagcgattctcctgcctcagcctcccgagtagctgggactacaggtgtgtgccaccacgcctggccaattttttgtatttttagtagagatagggtttcattgcgttagccaggatggtcttgatctcctgaccttgtgatctgcctgcctcggcctcccaaagtgctgggattacaggtgtgagccactgcgcccagccagttaacttctttttatttttttttttactttttttttgagacgaagtctcgcttttgtaccccaggctggagtgcaatggcgcgatcttggctcactgcagcctccacctcctgggttcaagcgattctcccttctcagccttccaagtagctgggattacaggtgcgtaccgccacgactggctaatttttgtattttaagtagagatggggtttcaccatgttggccactcctgacctcaggtcatccccccgcctcggcctcccaaagtgctgggattacaggcgtgagccaccacgaccggcttcagttaacttctttttaaagaaaatttctaaattttggaattattttattttacttatttttaattttaaaaattttaccctcctctcaagtttccaatggaataattttaaattgattgaaaagttgaaaagttagagaagaaaattgatgtgcccataacccagtctcccctgatcgtccataatcatagaacagtggtcagaactaagatattaacatcaacactttactgttaactgaaacacagacttggttggatgtcaccaggccttccactagtatctcttttctgtgctaggacctagtccagtgttccacattgcatttggaactaacgttttttaaatacctgtatgatgccagacatgttcatgtacataatcagaatactagagaggtgcacatttgtgtgtctcgttcgaatccccatcctaagactactgaaacagttttttgcgtagcaccagcaaacctgcatttcccctctgtcttcatctgcttgggctactgtaacaaataccacgggctggatggcttaacatttattttctcatagttctggaagtccgagatcagggtaccagcagggtccggttctggggagggccttctttctggcttgcagactgctgccatctctttgtgttctcatatggtacagagagagagggagtaagctctctggtgtctctttttatgagggcactaatcccatcatgagggccccacactttcgagctcatcttatcctgatcacctcccaaaggtttcatctctaaataccattacactgggggttagggctttaacataggaatttggggagaacacagtttagttgacagcatgctatttcaaaaggcttaccaaaatcctccctcacatctcctctaggttaggggccaactaaatgttttgatttaaaagatgtggctgggcgcagtggctcatgcctgtaatcccagcccttagggaggccgaggcaggcagatcacctgaggtcaggagttggaggacagcctggccaatatagtgaaaccctatctctactaaaaatacaaaaattagccaagcatggtggcacatacctgtaatcccagctactcaggaggctgaggcaggagaatcgcttaaacccaggagatggaggttgcagtgagccaagatcatgccaccgcactccagtctagatgacagagtaaagctctgtctcaaaaaagaaaaaaaaaaaaaaaattaaggccgatgcggtggctcatgcctgtaatcccaacattttgggaggctgaagcgggtggattacctgaggccaggagttcaagaccagcctggccaacatagcaaaaccccttctctattaaaaaatacaaaaaaattagctgggtgtggtagagtgcacctgtggtcccagctacttgggaggctgaggcatggaattgtttgaacctgggagttggaggttgcagtgagccaagatcatgccgctgtactccagcttgggtggcagagggagaccctgtctcagaaaaacaagcaataaataaataaataaataaataaataaaagatgcttgctctagagtgctatggaaatgcaagtactttgcagatgtcgatgccagcagtgattgacctgggacattggaggatgttgagaagaagaaaactggtttcgtaggatcggagacttttaaaatttattattttgaaaaagtgttaaacttggagaaaacatccagtgagctggctctccttaccctttccagagtacttacgagtgcctgtttcttctgaaacctgttcacatagtggcatagcatgtgccacggctgcttactgctgctgggcgtctttccctagggtgaggggttctcctgtggcagtccagggccaagggcactcaggaaattgcacacagacccagtatgtcctctcctctgcagctcatactctccttttgttaactgccaacagcatccttcatggcattgtttcactgtgtcccagggtccagttcaggggtacatcctgcatgtggccgtcacatctgttgagtagcctttcacgtggaatggggtctctgtctctggttgtctttcatgacattggtgtttttgaagaatgcaggccagttattttgtccatcattcctcagttggggttcgtctaatgcctggattatgcatcccagacaggaatattctaaaagcaatgtgtctttatcacattttcccttccggagccaaacagtgttcatctgcctcatgacaaagctaatttcttactggtcaggctgttacctgtcttttccattatgtagtttctgattttatttctttgactaatcagcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcactactcttaccctgcctgcccagacagtactaggaaaagatttaaatagcactgggggccaagtactaacttgaaccaaagttagtaaagataattttaaagaaactgactcatctggataattgtctttaaaaacccatctgaagtgaactttctcggtgcagtccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacaggctagtcacttttgtttacctactgaattttacctagagacaatgtttttaaccatcttgccccttaaaatatatttttatgtatctgtataaactatttttcaaccatatccacttctctttaaacaggggttaaattaaaaatatttagcaagcttttttttttttttgagacggagtctcgttctgtcacccaggctggagtgccggggtgtgatctcggttcactgcaagctccgcctcccgggttcacgccattctcctgcctcagcctcccgagtagctgggacttcaggcacccgccaccatgcctggctaatttttttgtatttttagtaaagacggggtttcatcgtgttaaccaggatggtctcgatctcctgacctcgtgatccgcccgcctcagcctcccaaaacgctgggattacaggcgtgagccaccgcgcccggcctatttagcaagctttgtggaagggtgtcactgaatcagaagaacagatgctgcccgtgaccactcagttcagcttgtttagaatagaccacagtgtacccctaacgccagccaaacgaagctgttttgaccttttccacaagaccctgtgcaggcggcttcttttgtctaaatagccttcccacttggcctggcggtgtcttcctgccttctgaggcctggtgcgctgtgcctccttttggaatccgggattcaacttgccctttgccccttgtgtgctccccgaaccctttcacccctgttgaaggacgccccgggggagtggtgggctctcagttgtgtggtagaagagttcctttggctcagtgcctaggatgcagttgggggctggagccggaggcagggtgtcctgttgggacaggattgaggttgtcggggtggggcgaggggaacctgagcaaggaggaggacgtggaggaagaggagagtacagggcctaatgacgcttgaagagaaatgcggtgatatgactacccacacgcataagtgatttctttaaaaataagttttgaaagttgataaaataaaaacacacaaataagaaagtaagccccctgttataacaacactatttaaaatgaggccgttccctttggctctgtagtttgtcagcagcttggtctgccccatgactatgcagcagggtttcgtggacattctggacattttttgactgttttcctgttggtgaatgttgagattgtttgcatattttcttttttcttttttttgagacagagtctggctctgtcacccaggctggagtgcagtggtgcaatctcagctcaccgcaacctctgcttcctgagttcaagtgattctcctgcttcagcctcctgagtagctgggattacaggcatgcgccaccatgcctggctaacttctgtatttttagtagagacggggtttcaccatgttggccaggctggtctcaaactcctgacctcaagtgatccttctgtctcggcctcccaaagtgctgggattacaggcatgagccactgtgcctggccaattgtttgcatatttcactgcaggaatttcttagtcagagatatttgcatttagctcttaattagattgagacatttcattgcaaaaaaattttttttttgagatagggtcttgctcagtgatgcgatcatgggtcattgcaacctctgactcctggcctcaagcaatcttcctgcctcaccttcctgagtagctgggaccacaggcatgcaccactacacccagctaaattttatatatttcatagagacagcgttttgccatgttgcccaggctggtctcgaactcctgggcttaagtgatctgctcagctcggtaccccatagtgctaggattacaggcgtgaaccactgcacttggccaaggcttttttttttttttttttttttttaaacttatatgcccattaaaacatatggaagtttctggacagcactggatattattaatataaatgagttaagtaagcataactaggtttttgttgtgcacagcgtgcatgggcacacacatcactgctgggtgctggggatgccatggcctctgtcagtcttgtgtttttccctagcattatagtgtgagagttgacccacgtgcgtagatgtttgggaaaaaaatagtagctacatatgtattcatattcagtattctacctttcagcttgttatttcatcattcttgtattaagggacacataattttaagctttttttttttgcctttaatattttactgatctttataaggtttgttcaagattttggattgattgattggttgtagagatggagtctcaccatgttgctcaggctggtctcaaactcctgggctccaaatgatcctccaccttgacgtcccaaagtgctgggattataggtgtgagctgcgaggtaccacgcctggccaggatggattgattgatttcttttctttctttctgtctgtctgtctgtctttctgtcttgtcttgtcttgtcctgtcctgtcctgtcttgtgtcttgatggagttttgctcttgtcgcccaggctagagtgcagtggagtgatctcagctcactgcaacctcagcctctggagttcaaccatttctcctgcctcagcctcccaagtagctgggattacagacacctgccaccaagccccgctaattttttgtattttttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctgggctcactgcaagctccgcctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgttggtttgggaccacaccggagaaccactgctaactaatagtcccagacattttataatatgtcatcgtttacagaagtgtttaatatacctcatctcatttaattcttttttttttttttctgaaacgaagtcttgctcttgtacccctggctggagtgcaatggtgtgatctcagctcactgcaacctctgcctcccgggttgaggcgattccacccaccccggcctcccaaagtgctgggattacaggcgtgagccaccgtgcctggccattttttttctttctttttttttttttttttgatacggagtcttgctctgtcgcccgggctggcatgcaatggcatcatcttggctcattgcaacctctgcctcccaggttcaagcgattctcctgcctcagcctccctagtagttgggattacaggtgcccgccagcatgcccagctaattttttttatttttagtagagacagggtcttatcattcttggtcaggctggtctcaaactcctgacctcaggtgacccacccgccttagcctcgcaaagtgttgggattacaggcgtgagccaccatgtccggcctcatttaattctcataacactttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaatgcacccaaagccatgtagccattaactggtagagcccaagctcagacactagaattaattctgtctgaaaccaaatgcaagcttggtccattgttctagactgttgcacttattctgtgctggccagctggcataggcaggacaacactgtagtgtggggacattatcttcccagtggcctagatgggaaggttaagttcagaagctagttgggtctgattccagagttcaccttgccagtccatttattggtggatttccttccagtgttttttccccatccataagcttgtggtttttcttttttcttttttttttcttttgagacggagtcttgctctgtcacccaggctttagtgcagtggcgcgatctatgctcactgcaagctccgcctcccgggttcacatcattctcctgccttagcgtccccagcagctgggacaacaggcgcatgctgccatgcccggctatttttttttgtatttttagtagagacagggtttcactgtgttagcaaggatggtctcgatcttctgacctcgtgatccgcccgcctcagcctcccaaagtgttgggattacaggcgtgagccaccacacccatctttttatttatttattttttgagacagtctcactctgtcgcctaggctggagtgcagtggcacgatctctgctcactgcaagctccacctcccaggttcacgccattctcctgcctcagcctcccgagtagctgggactaaagccgcctgctaccacacccggctaatttttttgtatttttagtagcgatggggtttcaccatgttagccaggatggtctcgatctcctgacctcgtgatctgcccgcctcagcctcccaaagtgctgagattacaggcatgagccactgcacccggccctgtggtttttcttaaatagtttaagcttaacttttatttctgtagttgaaaattacatttaaaaaagctgtagtgaggccgggcacgatggctcatgcctgtaaccccagcactttgggaggcctaggcgggtggatcatgaggtcaggagtttgagaccaccctggccaacatggtgaaatcccgtctctactaaaaatacaaaaattagccgggcgtggtgacagatgcctgtaatcccagctactcaggaggctgaggcagagaattgcttgaacccgtgaggcggaggttgcagtgagccaagatggcaccactgcactccaacctgtgcaacagagtcagactctgtctaaaaaaaaagaaaagaaaagaaaagaaaagctgtagtgatctacatctgaaacacttaatgtgtgtttttccatttagggatcagaataaatacaaagatgcagctaacctactgaatgatgccttggctattcgtgagaaaactttgggcaaagatcatcctgcggtttgtatatccagttctttcattcttttaatattttattttccccatatatttcttttatccaactcattttaccattaaactcaacagggaaagtttaagtgctgccttttccctagatggtgcaggtaggaggtcttcacttactcagtgctagtgacaggccagagcacacttaatttgtttatgaccccacctcaaatggatcaccaactgtattgtttgattgtaaatcaaattgcatgtccttctagaaatttttttctgaaaattatattgtcttcattaaaatctggtcagatttgcatatgaatctgttttggttggctttgtggcttccagggaaatttttaaaaagtcaggaatacgttgttgatttgtttaattttagtattctgcagtgttactttgtataatctatactctagtgaattgcgcttttcattttaactgaagtcatattgttctatccgactaagaatgctttactgtatagattgaatataaatgaatatgtggtgtataaatgtactcttatttggttatcttttaccattcttagtggttctctctgtgttgacaggtggcggcgactttgaataaccttgcagtcctttatggtaaaagagggaagtacaaagaagcagagccgttgtgtaaaagagctctggaaatccgagaaaaggtacaaaagaagggggcagtcgttttctttgagatttttgttttgtgtgtgtgtggttttttttttttttttgagatggagtctcgttctgtcaccgggctggagtgcggtggcgtgatctcggctcactgcaacccccacctccatggttcaggtgattcttctgcctcggccttccaagtagctgggactacagggacacaccaccacgtccacctaatttttgtatttgtagtagagatggggtttcaccatgttggccaggatgttctcaatctcttgacctcctgatccgcccgccttggcctcccaaagtgctgggattacaggctgagccactgtgcccggcgctgttttttgtgtttttaaaaatttttcggttttaggttttgagaaataaccactgtgatgtgtttttaactgactattagctgaaaacaactcatttaattagagaatagcccacaaaacaaagccagattggcccatacaaatcagtgtttaagactcaattacaggctgggtgcagtggctcatgcttgtaatcccagcactttgggaggccaaggtgggaggatcacttgagcctaggaagtttaagaccagcctgggtaacatagtgagacctcgtctctaaagaaaaaaaaaagaaaagaaggtccagttatgaggcgtgtgcatttagaaaggtgcagtcctgagtctgatgctgtccaagcctgatatggcctagaagtgactctgattgaagaagacatgtctgaggactagagatggaaagcctgggagcattgcatttgacagtggaacatgtgcttgtcaataagaaaaacatgattaaagataaattcaccaaatatgctttatgaagctgaaaaatgaaataattattattataactaaagattaactcagagctatagattaagtcaatgtcatatatatttaataccagctgctacagttcatggtaattaggtattaaaaaatataacaacttgttcatttcagcagtgctgtgtatgacaatctctttagatgttatgaagattcgggtattgggtctatccgatgagtgaccacaaattgtgtttttttttttctgaaacggagtcttgctgtgtcgcccaggctggagtgcagtggcacgatctcggctcactgcagccttcgcctcctggattccaggaattctcttgcctcagcctcctgggtagctgggattacaggcatgtgccacaacacccggctaatttttgtattttttagtagagatggggtttcaccatgttggccaggctggccaagaactcctgaccttaggtgatccatctgccttagcctcccacagtgctaggattacaggcatgagccactgcacccagccgcacaaatggtattttaacctggtattttttgtgattatttatcagtgattcttatcagttaattttgagccacatggcaaggaattgggggagagaaaataaaaaggggctccttatcaaattatacaggtaatattttatcatgctgtcaatctgcatgatatttctgaaatagaatggttgaatttggggtgggctggagttaaagtcagggagagcacaaaagtatcaaattaaggattaggaaccatataagatgacctgccaaattcattcatatatttaccctttcattcatttagagccccctgcttagagttggtgatttacagatcagacatgtagttcctcccactaggacacagtccactggacagactgaggaccgcagagggcacatcagcatctagaatagagagctctgggaggatatgaagtgtgggcttctgcgggccagagccagggggtgttggggatggtttctcagggaaggtcggtgttggaactgcatcttgaataattgagttaaaagtgtcctaggcagggggaggtagggaatgcagaagggagtagaaaggcagcttacctccctgaggaccacatgtgtaaaggcacaaagcggagagaactcatcacttgttcaaggtactgagggaggaggttagtgttcattcatctatctctgtgccagacccctttttcgatgcggagattacattggtgaagaagagagacaaagaatttatactcttggggcttacattgtaataaaaaatattcaaggtagtttagagaagtgattcttataaagaacaaccaggtgatgtgcctgtgagttcactaggtgaggtggggtggtatagggaagtctcctttgaggggaactgaggagaaccctgaaggataagtcgtagctagtagggagggctaggagaagagcatcctgggcaactgggacagctgtgggctcttcagaagctggcagtaaaactcacatagcctttacaaagcccatttccttatcttcaaaatgtgcctaatgtgtacatttgtacatagtacaaccaatgtacaaaaatataactaccatgaaggattactacagtaattaacacagctaaagaagatgagcacagttccctccctcccctcatgaataagaatttgagaaattctggttattttattactacgtggtgtagcgagccagttaaggatttaaatctgaaagtgtagcacagtcgtgcttatgttgaggaagatcctgatgtgacagtagggtggagaatggattggatggaagcagaacaagtgtctctaatatgctgttttttattttcaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggtgtgttgactgcacagcactagggagggggccaggagtgctttcgtcccaagtccaaacactttctcatttaactggagattaaaatgtatgctttatttacatctgaaagatatgaaatattttattttattttattttaaggcatcctgctatttgaaacaaggaaagttcaagcaagcagaaacactgtacaaagagattctcactcgtgcacatgaaagggagtttggttctgtagatggtaagaaatatactcccgtttcaagtgaatttaattgtataatgacttgactaatagtaatatactaatagtattagttactgtttattaagcacttaactttgtacatcactaagctaaatagtttaaatgtgtgatttcacttcactttcacagcagtcttgtgcagcgggtcaaacattaccccattttaaaagcaaggataccacaggccgggcgtggtggctcacgcctgtaattccagcactttgggaggccgaggtgggtggatcacgaggtcaggcgatcgagaccatcctggctaacacagtgaaaccccgtctctactaaaaatacaaaaacttagccgggtgtgatggcggccgcctgtagtcccagctactcgggaggctaaggcaggagaatggcgtgaacccgggaggcggatcttgcagtgagccgagatcgtgccactgcactccagcctgggcaacagagtgagactctgtctcaaaaaaaaaaaaagacaccacagactaagtgacttgtgtgaggccccgtagctgagaagcagttagactgggattacagtgcccagagcccataacatgtcctcattgcagagacctatacagttcacgcagaaatggagacaggagcatcacccaaatccatcttcatgtcctcattgcagagacctacccaattcatgcagaaatggaaacaggagaatcacccaaattcatcttttcacatttttaatgtctttccttccttctgtgcctttggtttacagatttcaaaccataccgtccatatcatcatgtatactgcttattttctttacatttttagtgtgagtacctttcagtcataaaaatattttcataaacattacttttaaggtggctttttcctccatagcatgggtctgttggttgtctagaaacttgcgtgagtgttccgagaagatgacttaaaacgaatattgattcgtatgcttgttttcttttttttttttgaggtggaatttcgttcttgttgcccaggctggagtgcaatgatgtgatcttggctcactgcaacctctgcctcctggattcaagtgattctcctacctcagcctcccgagtagctgggattacaggcacacaccaccacgcccggctaatttttgtatttgtagtagagacagattttcaccatgttggccagactggtcttgaactcctgacctcaggtgatcctcctgcctaagtcccccaaagtgctgggattacaggtgtgagccactgcacccggccttgatttgtatcttttctacttttgctagcaacatcttgctactttttcttagactattgtttaatgtttttgtttagtgctcacattctgaatactcccttgtgctacttgagcagctggcattttagaaattacattccagggccctagcatttgctggggtgtcttgacagttgctcacctgtctcaggacattgattctgtaccctgtgtcttacctgttgcttggtgtccagctctgtcgtccatagactttttcctccagtgtgaacctaatctgtccatgctgtaagaagtagtatctaacaaggatcatataaaaaagaaaacaggctgggcgcggtggctcacgcctgtaatcctaacactgggaggctgaggcaggtggatcacttgaagtcaggagtgaccagcctggccaacatgacgaaaccccatctctactaaaaatacaaaaaaattagctgggtgtggtggcgggtgcctataatcccagctacttgagaggctgaggcaggagagtcacttgaacccaggagctggaggttgcagcgaggcgggatcacaccactgcactccagcctgggcaacagagtgagactccatctcaaaaaaataaaaaaccacagaggcttcatgatttctagtttacttagcaggctctgttatccttcatttatagtacaggttaaatatcccattattcaaagtgctccaaagtttgaaacttttcgagtgccgacttgacactcaaaggaaattccccttagagcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttggagagtatggcggctggtacaaagcctgcaaagttgataggtatgtctggaattgcgtttggctggaaaaaccaaaaagcagggggaaggtaattgtgttctacagggcagcttataaatgaccaatgtgtagtgttccttaagtgcacagtcccatgtttttcccgaattccaattaaaaaaaccccactaaccttgtaaatgagatcacttacatgtataaaacccactatcatgttaggttggtgcaaaggtaattgcgattttgccattacttttacttttaatggcagaaaccatacagtaaattcatgagaagcatgccagcaggcctgggaaagccagcccctcacacacagcgctggagacacagatccacacacactccttttcctcacagcccatggggccttgtcctctgcagagggaagtgtaggcccctccgtggccggcccgagagccttgcctcttgagcccgagcctgtgcagactgccctctgtgatggctgctgtccctgggtccaggtggctcacctgtttggctgtctttccactctatttttttttttgagatggagtttcgctcttgtctcccaggctggagtgcaatggcgtgatcatggctcactgcaacctccacctcccaggttcaagtgattctcctgcctcagcctcccgaatagctgagactacagtctgtcgccatgcctggctattttttgtatttttagtagagacagagtttcaccgtgttggccaggctggttttgaactcctgacctcaggtgatccacccgcctcggcctcccaaagtgctgggattacaggtgtgagccactgtgtctttccactcttaactttcctcatcctttaagactcagcctaccattcatctattttcagaaaactctctgaactctctctagggctcccatagcacttaccatagattacttgtttcagagacatagaaaatagcttctttatttctgtacccaaaatgcctattgtaagtaagtgaacagaactctctcgaagtacttatctatgctaaaatgaatctaggtttatttataatttttttagtaagtctgctctatcaagaatgcagaaacatcaagctcaatgatacagtttgaaaaataagaaagaaagaaagaacacagaaacacagccgtcctctcggccatctgcttattgcttccctggtacatgaagcatttatcctctgccctcacaccccactgataaggaggttctgctttgctgtcttctcccgggtacttgaggggagacggcagcacgtgagcagcaacattcagagcactgttcgtcgttactgtcagcgcagaccaagtcgtctccagggaaagcatgctgataccacacagacctggcccagatgtttctgttgacagagtggccagtggtctgtgagagccgcctcagcctggatggagtgtggtgttagcctggcctgcaggggctgtctacaggacgggccagggtcatgggaggtagagctacctgagagggaagaacgctttacaattttacagtttcagaaaagtacaagagaaagttaaaatatattcaagccaaaacagaagtctgttagttctttagattatgtgctgttgatagtggttgttcagagcttatatgtcatagttctgtatgtcatgtgctttcttacagtccaactgttacaaccactctaaaaaaccttggggcactttacagacgtcaaggcaaatttgaagctgcagaaacgttagaagaagctgctatgaggtctcgtaaacaggttagtcatacttctgtccttaaccggcccatgggaactttgaattgaatgcttctcttttacatgaattttattgaaagcttgatttagaaatagaaaatgttgattattttagtttgaacaaataaagttatattgtttaaaagagcatgaggccgggcgtggtggttcacacctttaatcccagcactttgggaggccagcgtgggcagatcacctgaggtcaggagttcaagaccagcctggccaacatggtgaaaccccgtctctactaaaaatacaaaaattagctgggcgtggtggcacacgcctgtaatcctgtaatcccagctactcgggaggctgagacaggagaatcgcttgaacctgggaggtggaggctgcagtgagccgatatcatgccactgcactccaacctgggtgacagaacgagactccgtctcaatttaaaaaaaaaaaaaaaagcatgaggctgggcacagtggctcacacttgaatcccagcactttgggaggccaaggtgggtagattgcctgaggtcaggagttcgagaccagcctggctagcatggaaaaaccccatctctactaaaaacacagtgcagtggcacaagcctgtagtcccagctactggggaggctgaggcaggagagtcgcttgaactcaggaggcagaggttgcagtgagccgagattgcactactgcactccagcctgggcaacagagcgagactccgtctcaaaaattaaaataaaataaaataaaatagcatgaatatgaccccaaaagcatgaacagcaaaataaaaactagatctgttggattcaccaaagttaaaagctcttgtgcatctaaggacatcatcaagaaagtgaaaggggactgggtgtggtgctgagcacctgcaattcctgcacgttgggaggctgaggtgggaggatcccttgagctcaggagttggaaaccagcctgggcaacatagtgatactttgtctctacaaaagtttttttttttaaattagccaggtgtgttggcccaagcctgtggtcccagctatttgggagtctgaggtgggaggatcgcttgaacccgggagctggaggttgcagtgagcttagatggtaccactgcactccagtctgggcaacagagcgagaccctgtctcaaagaaagaaaaaaaaaaagaaaaagtgaaaagacccccatgcaacaggggaagatatttgcaaatgatgtatctcataaggttttggtatccagacaaaaagacaacccagttaaaaaatgagcaaaggacctgaatacacattttactgaagatgatatacagatagccaacaatcacatgaaaagatactcaacatctttagtcattatagaaatattaactgaaatcacagtgagatactacctcatccccactagactggctataataagcgaacaaatggaaaataggcattggtgaggaggtggagatgctggagtctcatgtcttcttgctggtgggaatgtaaaatggttcaggcattggagaagtttgatggcttatctaaaagttaaacttagaaaaccacatgacccagcagttgcagtcctaggtatagacccagaatagttgaacacgggtacacaccctgtgcaatcccagccccatcactgttcctctgaggggtcctttgtgtttccagttccccgcctccaccctcaccccctccaaggaaccactcttccaatgtttttccctccagtgattaagaactgttttttttttttttttctagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggctatttaaagcatgatccctgtctggtttcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggatttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccgagacaagaatcttgctctctcgcccaggctggagtgcagtcacgctatctcggctcactgcaacctctgcctcctggttcaagcaattctcctgcctcagcctcctgaggagctgggattacaggtgtgcgccaccacacctggctaatttttttatttttagtagagacagggtttcaccatgttggccaggctggtctctaactcctgacctcgtgatctgcccgcctcggcctcccaaagtgctgggattacaggcataaaccaccgacttttcttattttttaaatggtagggcagtatgcacataggtattaatttttaatcaacttttttgagggataattagagacagtaaaaggggcccattttaactgttgtctgatttaaatattaacacggttcaggtcagcacattagtttgtctttatatagatgttagaacaaagtttctcatgctgtttctgtttaagtgaaaatttccctgagattgcaaagcaaaccgttaccactgtagccacttacttgtgtgcatcaagatttttttcagtattatgcaattaagttaaaatagagacataggtgttgaggtaaatgttaagactataccttgccgggcgcggtggctcacacctgtaatcccagcactttgtgaagctgaggcgggcagatcacgaggtcaggagatcgagactatcctggccaacacggtgaaaccccctctctactaaaaatataaaaaattagccgtgcatggttgcgggcgcctgtagtcccagctactcaggaggctgaggcaggagaatgatgtgaacccgggaggcggaccttgccgtgagccaagatcacgtcactgcactccagcctgggtgacagagcaagactctgtctcaaaaagaaaaaaaaaaaaaaagagtatacctgtgcccggttgctgtagctcatgcctgtaatcccaccactttgggaggccaaggcgggtggatcatttgaggttagtagtttgagaccagcttggccaacatggggaaactctatctctactaaaaatgcaaaaattagctgggcatggtagcaggcacctgtaatcccagctacttgggaggccaaggcagggaatcccttgaaacctggaggcagaggttgcagtgagccaagatcacgccaccgcactccagcctgggtgacagagcaagagtgtctcgagaaaaaaaagaaaaaagaaaaaacaactatacctgttatctgtataatgagaaaatgtgatttcaattatatatatatatatgtatatgtatgtatatgtattttttttttttttttttgagatggaggttgcccaggctggagttaggtggcacaatctccactcactgcaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggttaatgataatcgtcccctgtgggccctgggcgttggtgtcacacagaactgagaagcaaagcgggtggtgacagaccctggtaatgtgcagggagcgtccggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagtatattcacgtacatggtaattggtggtttctgcaagactctgtcagcagtgagctgctggcaagcagggcggccttggtggagctcttatttgcacccggtgtggctcttgtgggaaggagggagaaccacctgcagcttcacgtttgttcacgtttttttcaggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgatcagttgtttcgttactctgtctttttcgttgttgttgttgagatggagtttcgttcttgttccccaagctggagtgcaatggcaccatctcggtcaccgcaacctccgcctcctgggttcaagtgattctcctgcctcagcctcccaagtagctgggattacaggcacatgccaccacgcctggctagttttttgtatttttagtagaaacggggtttcaccatgttagccaggctggtctcgaactcctgacttcaggtgatcttcccgtctcggcctcccaaattgctgggattacaggtgtgagccaccgtgcctggcctattttgtcttttaaaagctatttaaaaaaaaaagtatgtccactttttcatctctctcagtatccctgataacctaagcccttagaactgttgccatacacggccagggtgcggggtggccagagatggcccagtcccttagtggtagggctcaccctcttgtccgcttggtatccctgtgggagtctctgtcgtggatggagacttctcttcatggctgtgagagaggtgcaggcctgaggcaagaggagtgacgtggcttttgtaaggagcttctcacaactgttttccagcccatttctggagagggagttttaggagccccacaaatgttcattcagaaaactccctggaagatcccaaggatttgaagactggacttctggaagtttatggggacttagcagcaaattgcttacaatgaaacaaatgaactcttatttgggggaaatggattttaaattgcctttggaatagtgatcttattttaaaatgtttacagatttccagaaccaaaatgatagattactatctgcctctcgatgaattttgagattacacatttcttcttaaacagcattgagagggttggagcagtgctgtgtgactgcttggtgtcgcttccttggaatgatgtgaggtgtcacacagcagctctcagatcccctccaggaattacatgatgcccagagagagcattctggacattatttaattcctggaggggatcacactgattgtttgaggttcttaagttttgaagccttttaagtgcagagtccagttctggtgctgagtgttgtaacttggaccacactcccacatgacagctctcagagttgttctgttttctcgtgttttgtgtctttgccgtgataaaaatgtagcagtgtgtgaccagtccccagtgttagaactgtggtcagtgttcatggggctgtagcactgccagcctgaaccatgtgacatagatgcacacacttgcacggactaacgttttctacatgactttggaaattgcatcccgtaaaatgcatacaactgaataatctttccaaataagagtgactgtttttattaactagacagtagtctcagacatcttttggagggtttgttcagacagagactgtgaggccccacccctgagtttccaattcctgagtccctgatctcagaatttgcatttcacacaagttcccacagtgctggggctgctggcccggggccactttttgagaatcgctcaaggaccagggtgtttgcagcttgctgtttggctgactcctaacagtgactgtactgaaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaatcccagcactttgggaggcctaggtgggtggatcacttgagatcaggagtttgaaaccagcctggccatcatggcgaaaccccgtctctactaaaaatacaaaaattagccgggccaggtggtgcatgcctgtggtcccagctactcaggaggctgaggcaggagaatcactggaacccagtagggcagaggttgcagtgagccaagatcacaccactgcactccagcctgggcgatggagtgaaacttcgtctcaaaaaaaaaaaaaagttaatggccactttatagcaagaataactgagtatgtcagatgataatttacttgtgatttggtttgattttatactttgttcttgagtggttctaggtagagaaaaacctgtttgggactccagcaatgtctgttgtgggcttcattgggatgtttttgttttgtcctggttgggacattttgggggtgagttttgcctggggataaggaaattcaggtcttgcttttggtgcagttgttcggcaggggctggctgagtatctgccatgtgccaggcgctgtgctcacagcactgctgacacacgggtgggtgccctgggctttcagcctcatcccagtgtcctgtgtgaggctgtccctgtcacccctcaagcctgtgcctcagcctcacagccaccgtccttggctttcccaggaactgctgcgctcatgttcgctgtcccatgttgcatgcagttcacgttcagaattcaagtaaccctcagtatcggttgctttagctttaaaacttcaggggagtttatgttcaaaggcatccatggtggtggtgaacaacgatagtcattttatgactgtccatcatttaagttatagattatttataggctgtttcatcaagtattttaaatacatcagatggaggaaaagtaaatatatgtatacattcctgtattcctttaagtggagaaccatgactttatgttacattttgctttctaagtagaaaaatactggcttcagagtttattttactaacaataaagttgatttcccagcttttaatatagaaagataaaaaatatgacagtatatttatgcatcatcttttagcagtgagttttgagtgtctcttcatgatcccttagtggtgacgagtctgacatgagccctggagcaccctccctgaaaagcatcagactgaaggcagagcctctctgctcccagatggttccccccactttttttttttttttttttctgagacagagtcttgctgtgtcgcccaggctggactacagtggagtgatcttggctcactgcaacctctgcctcctgggcttaagtgaatcttgtgcctcagcctccagagtagctgggattacaggtgtgtaccaccacgcctggctaattttttgcatttttagtagagacagggtttcaccacgttgcccaggctggttgtgaactctgggcctcaagtgatccacccgcctcagtctcccaaagtgctgggattacaagcatgagccaccacgcctggcttttttttttttttttttttttttttttggtaggtggagtctcactcttgcgtaggctggagtgcagtggcgtgatctcagctcactgcaacctctgtctcctgggttcaaatgattttcctgcctcagcctcccaagtagctggaattacaggcacatgccaccatgcccagctaattttttgtattttagtagagatggggtttcaccgtgttgctcaggctggtctcaaactcctgagctcaggcagtctgcccgcctcagcctcccaaagattacaggtgtgagccactgcagctggtcttttttttgtttcgttttgttttaaagagagacagggtcttgctctgtctcccaggctggagtgcagtggtgcagtcatggctcactgcagccttgaccacctgggctcaagtgatcctccacttctgcctcctgagcagctgggactacagatgcatgccaccacgcctggctaatttttgtatttttgtagagatggggtttccccatgttacccgggatggtcttgaactcctgggcttaagtgatcctcctgccttggccttccaaagcattgggattacagacttgagccactatacccagtctagatgagccactttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcactttttttttttttttttttgagacggagtctaactctgttgcccaggctggagcgcagtggcccaatctcggcccactgcaagctccacctcctgggttcacgccattctcctgcctcagcctcccgagtagctgggactacaggcacccgccaggcggatcacaaggtcaggagatcgagaccatcctggctaacatggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatggctgggtgcggtggttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgagcagagtttggaacccagacagtttcccttagtgacagttatctggaaaggaaaaagggcatttagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccacgcgagagtcagcacctgtttcttcagagttgctgtcaaaataatcactgcgcccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgcacttttgcagaaaggctgttttgtaaaaatccaaccccaaaataactttttcccatgttcatgccagtgattcttaactttagggtcatagagagccttgataacatgatgaaggtttaaacggattgtcccaccctggaaaacggcaaacagaaaaattctgcacagtatggccccagcccttacctttcccccaaccagtgccagccccccttcctcccactgtaggagcacccacaggctcaccctgggcacataaggtggggggtgacaatttctgcctctgggttgtgggaggagtcaagctacttaacggttctgggcctgaatttccctacctgcaagtggagatgtaacagtacctatccctaggagttgtgaggagaacatacttcaatgtgtataaattactcagagcagtgcctggcagacagcaagaagcaggtcctggaactgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagtgacgacctcctcccgtgtcccatcacccttgacagctgattaggcgcctcatcttccactgtcccccgggcggcctgatctggcaggtcagttgaacctgcatccccttcgcccctgggggttcctcttagcaaccttccatcctctgcccctgcccagctctggagctgtaagccgccaccagcccatggcctgttcagagctgagcccagcctctctcccactgcaagaccgcagtgtggtggttcccacatctctcaaaggttctgaatgaaagcctggtctctgcctaacgtgctttcacagatatcctggaatattttccctttaacaccaagcacctgccgcatcccagacactggcctgggagctccacagacagcccggcacatgcctctgtcctctcgccgctgtgaggggcaggggtgtgaccagcccatctctctacaccggggtgaaggccacacacagggagcagcccacagcaggcaaggggctggcccaagacagacctgtatgtcttcctgcagcacccgagctgagcaatgacttcagggggagagctgatgtcacgtgctgctaggtgagtacggacggtcacaccagagctgttaggctcacacaccagactctggaaatgccgtggttactgcctggagctgctctgagccttccgaggtggactcactcctctgccttgggccctgggacctgctgtgtagctttgaagtgattcacagcacttacatagtctgatgttttggggtgacctgacccccctgcaagagtgtgatgtcttatcagaccacatatgtgaggacttgagtgaactccgcaaccttgggaatgccacttaaaccttgtcagacactcccttatgtgagttactgaccctgactgctggactgcaaaaacagacatcagcttgaaggttgtgcagatgctttgaggcaagctatacgctgctggcctgggagctggacctcggtcccagcttctcagagagctcccgctctcacgctctccactgctaccaaggcaaacctcgaactctcaccagatctcactctccaggggcccgctccatcccagcagagcaaccggaccctggccgttctgccactcacctccctgccgtgaatgcaccccatccatggaggccctgcttccctgccaggtgtcttcacctcctcccctctcctcccctctgagcactgtgaacccgagaacaaatcttctttgacaataaaccgtgtgattcgtggaatcatactttgatcatctccttatttcctccacacacaaggacccctgcactgccaatggccccaggagagggcagagtcagccacagggaccccacctcacaggcttcaacactgctgatgcctgtcatcccagcaccgtgggaggccaaggcggccaaggtcgcctgagcccaggagttcaagaccagcctgggcaacacagcaagacctactctctaccgaaaaaaaaaaaaaaaaagaaaaatagctggccagtgtagtggcgcttgcggtcccagctacttgagagcctgggaggtcgaggttgtgcctagctgtgaagacgccactgcactccaccccggatgacagagccagactgtctcaaaaaaaacaataaaaattcacgccttgtaataaggaattaaaggcaggatgaacaaacattttcttcttttttttgtgtgctttctgagatggagtctttttctgtagcccaggctggagtgcagtaatgtgatctcggctcactgcaacctccgcctcccgggtcctggttcaaacaattctcctgcctcagcctcccaagcagctgggattacaggcacgtgccaccacacccagctaatttttgtatttttagtagagacggggtttcaccatgttggccaggctggtcttgaactcctgacctcgtgatccgcccgcctcggcctcccaaagtgctcggattacaggcgtgagccaccgcgcccggcctaaaggattttctttccaaatcaaagtattaaaataactgttcagacctctcccacttcgatgcgaagccagcgcggtcccaggcggacgagcgaaggcatcgaaggccgggggcgcagccgcgggcccacctcggcctcccctgagcggacgcctccccgcgcgcaccgggggccccggagaccgccttccccgctccgaacgcacgcggcccggccccggcgaggtgcctgaacgctacccgagctgcggcggggctcccggggtgagtgctgcagccccaggcccgcctgctcccacaggctcgggcaatggagacccgcggccgcccccgccccttgaccctgcctcacccctcacgcccgctgccgcccacgacctccgaccccgctgccgcccggctcgcagcccggctcgcagcccggctcggcgggcctcacctcccgcgggttccgcactcctcttcccgccgtcctgctcctctcggccttctcctccaataggcgcctagcaccctgagtgggctacaccaatcagagacgaagcggcgctaacgtgactgactaactaaccaatccaaagtctcaatctccctgagaggggcggagcgtacccgggccagccctcgccgccgattggtgatcgacctcagggttgcaggggcggtgcccttacacggattggagagggcagcgatggggcggagttcaagctccgattagtccgcgctccgtggcgggcttggcgattggacgccggcgctgtcagccgcgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggtgggtggccgtcgccccggccagcgcctccgacccgccccgccgccccggcccggccccgcgggcttccaggctcccgcgacgacccctccgcctccgggcggccccttccccagccggcccccgcccccgctctctcccaggttggccgcgtccccgggccgccgcctcaggctcctacgcccgcggggagggcgggaggcgcgcggtgtcccggtgcgggggtcccgggagggcaggaggcacctgtccagggcgggcgccgggaggcggggtgcggggcgcgggctggtcccgggggtgggtgcggccctgcccgaggccggttcgtgctgggctagcgcgtgtggactgcgtcccgagagctggggctcgctcccgagaaagtggaaggcggagcgccttcctcgcaggctcggtggggagggcgcgtgctgtccgcggaagcgctggagctggcggccccgcaggggtccctcccgggaaccgggggaggcgtcggtgccgcgggcgggtggccggttccgaagccacctcctgctcggaaggagggccaggacccagtctgcgggccaggctgccccccgtttcccttcgtctataccaccctccacctcggaagcgaggtcgcagtcgcccactggacagtttgaaggagaccgcagatttgcacccgtttcccatgggcccagacacggcaggagttgcccaggccactcctgcagacattggggcgtgggcgtggggtccctgagccaggccatccgctgggcctcccgtggggttccctgtgacctgatcggaggtgcctttgcctcacaccagccccttggccaactgggaaggccccgagtgcatttaatcccactggctgtgcgctaacaggtgtgtccagtttctgttctgtggattttaccacgataaaaaaaaaattgggggagaaaaagaatttttgtaatatgactttcatacttaacacgtgttacagattcgtttaattccctcagtgatagaactaagcagacgttggaactaggttcaagaagtcaaagtagcactaattgactgggttcattgaagcttggttggaggcctggtggggggtgagcggccacagagcctcggggacaggacggaattcgagtgactctggggaagtgtctctggcatctacagtgtacggagccatcaccggtcactgagcgtgtcctggagagttgagaccagtgctgcccacctctccccagtatcgccaccatgaggagtctttttagacactttccgccaatcatcctccttcatcttttttaaaatttacttttaagttgacacgtgaaaattgtatttatggtgtaacgaactcttaatagcacagaaatactctacgtctgtatgaaccgtaaggagcacgtgagaaagtgtggccaagatgaggcagaggtttccaccaaagcacaatttctttctccctgctgtacacatgcactgatcttacggttctgttttatagtgaaccactgtgttcccctccttcattctctcttccagagcccttctggtatcagctgaattgtttagcatttttccctgcctttctttgtggcctctgctgaggcactgtgtggcagtcccgcggtgacttccgactgagtggagttgaaacacttgagtcaaggtggcacccctcgtggaagagaagattcattcccacgctggcgtggtggcaggatacccctccagagccccccaccatgtttggatgattaactgggatctgagcagctgagggaggtcctagcattgggtgggcttgggggacagagaaaccattctaataagatggactttgtctctgagttttgcgttgtgaattgtattggagcatggtcttacaggccagaaacgaccaaagacagtgttctggaggaacttagaacggggcagtaagggctggaagatttggaataaagtccagctttaggtgcaatagctcgaggggacatgtacggtaacagtcgcctggcatgtggtgatgctgaaggggacactgagctacactgtgctggctgcgtgcttggggccgctaaggtgattgtcgggaggtgactcaaatgtgcagataaccagttgtgggaaataggtttatttgaggtggtttggaatggggagaggagaatttggtagaacttggcaggtgggtaacattgtccttggcttggtggccgtgtgccgatcggcatcatcgtcatatctgtaaacgtgttggtccattttcattccagctctgttcttagccaggggagtctgaatccagcccagtgcccgtctcccgaataccagctgcctgaccgggctggtttatcagtttgggcccatgagggttatccctttaaaatgctgcaaaaccccctggggagcatgtgcacacatgcacctttctccgagaggtggcctgcagctctcagattctcaaggctctgacgcagaaccagttgagaatcgtttctccagtctgtgcctcctcaggaacctgtggggcaggggaggcagaggcggcgtgtaaagcttcgtgcgacaccactttggatagaggtgctttgggggtgtgaaggaagcttcagatgatctctggggcttgtctgactctgccatcaaatatccgacactgacgcaaggcagtgggcttgggggtgggcggtccgggcgtgcagccatctgggcttgtcacaagcagctgagatcctgagttttatccttaaaatccttgccgctgtgcacccctcccacctcccatccgtggtgctggcagaagaatgaccgcagctccatgctggcgggttgacactttgatggatactctagattcagagccaggaaggagagagcacgtgcgcgtctgatcacgagcctggactcggatgaggagagatctgaagtgaggactgttgctagaggcgtctggagctgtgcagcggggagaacaggggaccctgagttctgcgagggtctcacaggccaggccggacagggcttttcttttgcagggaggagtggccaaggctagaaagaatcaagctggggaggtgggatgggccagtggagggtcaggacctccagcagatcagagagctgaggccagaatacaaaaattagctgggcgtggtgatgagtgcctgtaattccagctacttgggaggctgagacaggagaatcacttgaacccaggaagtggaggttgcagtgagctgagatcgtgcagctgcactccagcctgggcgaccaagcgagactccgtctcaaaataaataaataaataataaaaattcaaaaattagtcgggcgtggtggtgtgtgcctgtatcccagctcaggaggctgaggcaggagaatcacttgaaccgggaagaggaggttgcaatgagccaagattgtgccactgcacttcagcctgggtgacagagcaagactctgtctcaaaaaaaaaaaaaaaaaagtccaggtaagggaattgtgttccagttgatcatgaggagaaatggccagtgttttctgaggcagagaatgggaatttggagggccttgctgcaggtaagcaaggggggcatctgtgatctcctctggctcgtatggggagggtggttctcggtggaaggctttcccagcacactgcagggtggggggtttcataattgtttccaggatctcagcgcttgggtaaagctcacccctgtgaggtgccaggggctgccagagcctccacaggtgttctgggaaccagcagcctcatgagatactgccagggacaccagcgagctcctcaagggtccctgtggctggctaagagctttttcttttttgagacaaggtgttgctgtgtcacccaggctggagagctgttactgatgttaggtaaaactgagactttgaagccacaaaaaaggattcctgggcgtcctgtgggaggccaggccgcctgtagcataaccctcccaggctgtgatcatagtgtctgcacctgtcaccgtcttcaaactgtctgacagcttcaaattgtagaaaactgatagtaacgcacgtgtttctagtccctgagatgcaagtagattttgtctctcagaggtgaagttgatgtcctctctcacacaccccaccgcggggtccctgtgagaggagccagtttacaactcatatcttccttcctcacggcctgtatccatgtctgctctttggattctcctttgaactgggtttttagtcttattggttctctcattaactaatgaggtaaatctttgacgtgggttccttttctgtttgtaggagttacgctctaccagttaaacgtgattatctttcaataaaggtgcattgatacatgcatttaaattgttttttgattggcgagttcttggggggctgagaattagttgactgtgggagccccaccagccagtgggtgacgcttctcactgtagtgtgggagctcagagtgcgtggtggggcctgatgttttttgtcaccccagcctcaaagggagggcaggcctatgtccatgtccagcctgtgtcctgagacttggttctttttataactttttttgaacatccatttaaactccctaaactatactttcagattatatggaggcgcttttggtttcttgcgtgctgccaaaccccactctttggggtgggccgggtgctggttctgaggagctgccctgtgaccctcgaggggccgttcctgttgcattggagtgggggagcgggtctcgacctgcaggtctctaaggagctccatgctggtgtctgccgcactgtggaggagtgatgggcttcatgatttctgttttttgttttgtttgagacggagtctcactgtcacccaggctggagtgcagtggcgcgatctcggctcacttcagccttcacctcccgggttcaagccattctcctgcctcagcctcccgagtagctgggaccataggtacccgccaccacgcccagctaatttttaggttttattttgtagggacagggttgtgctatgttgctcaggctggtctgaaactcctgagctccagcagtccacccacctcagcctcccgaagtgctgggattacaggtgtggccaccacgcctgacctggtttcttctttcattgctcgcggccatcttgcttacccaccgggaagcctagtttatggcatctgccttgaccgcctccgagcatgtcatctggcagggtgggtgcaagtcagttgtggtttactggactagcaaggaggggacaagcgcccagggctctgactcctgtaggcagccaggagaagtgtgttccgaaatttcactgggagccgtctgcatgcacctgccctgatcctcgctccctcttggccccgcttcccttgagacagctccttctgtgtccatatagcttcccgccgagcctgtgattggccctgcaaggtggccacggaggcctcccatggaggtgagtgccaggcgccccagagaggcctgggccgaggctgcctctgtgacgccactgcacagggcacagagggctcctggagagcacttgggccccgccgtccatcctagggggcagtgtctgtcattagcgggtttatctgcttggcttgggcaagagggtcaggcagcagatgggtgttattaggggcactgcccaagctgaccttgcctcactctccctcttcatctctgtgtgtttgtcacagcctgcacctctggcctcgtggccctcactaaacacctttattatttatttattcattttcctcactaaacgtcttgaggcctgtttcattgggttgttcttggaggttttagtttccccagcgaatgtgctggtttgaaagtctgctccagcccacgctggtggtgacacatgtgtacctgggatgtgacgcagaggctggcattccagacaccgctggccacctacggtgaaaacggatgaatcacacttggtttctgggctttggtgtattctccctagctcctaaaatagctgttccactgagcatcagagctgcggggtccagttaaaggaggcgctggtgggagcctggtctggggcccggcttgctgtcctgcgcttcctttgcggggcgtgcttactggcggggtaggtatttggcagtagttttaccttatgtcttcatccattgctttatttcatattaaattgctctgttgataattttttaaatttctttcactaatataatcaataggaaattaccttatttaaaagcctatacatctaagctccttggttattttatagtaataaacttctggatcacttatatttttaagggggcaaatcctaggtgtggtctgtctctttttttttttttttttttttgagacagggtctcactctgcttcccaggctggagtgcaatggcatgaacatggctcactgcagcctcgacctcctgggctcaagctgtcctcccagctctgcctcccaagtagctgggactacaggtgtgcaccaccatgcctggctcattaaaaaaaatgttcaggccgggcacggtggctcacgcctgtaatcccagcactttgggaggccgatgcaggcagatcacaaggtcaggagatcgagatcatcctggctaacacagtgaaaccccgtctctactaaaaatacaaaaaattagctgggcgtggtggcgggcacctgtagttccagctacttgggaggctgaggcgggagaatgacgtgaacccgggaggcggagcttgcagtgagccgagattgtgccactgcactccagcctgggcgacagactccgtctcaaaaaaaaaaaaatgttcgtagagacagggtcttgctgtgttgcccaggctagtcttaaactcttgggctcaagtgatcctcctgcctcagcctcccaaagtgctgggattacaggcgtgagccactgctccagcagtgtggtgttatatttagaaattggcctttcagcttgcccaaacacaaactgcacagtaaatgtgaaaagcagtcctctttcaccaccgtctgctgagaatattgagagccctctcccctcctgtcgggcgctgtgggccagggtcaccatggagagaccatcaatagttactctcactggaacctggtgataacgtggcctcgtgtttgcttaagctcagagttaaaacccccgtgaagctttctctagcagattctagtggattctgtggctagtggatgtctggggtcagggaaggggccaccacacagaggcagggactgtgccaccgcacagcaggcagaacattccagaaccgacaggcccatttgagggcaatggcagggctgggctgaagcacaatcagggcggggaacagccagccaacgcccacagcccgtgggcagggagcccctggcagagctgccagctggactttttagatgcttccagaaggctggggtgggccaggcctggtttccaagtccaggaagcagcttaaaagcaaagggaaacaaaaaaaggctggtcgtgggatctcacaaagctcaggacctgcctgcctgagttggggcagtggcgacatggaactcggcagggatgaggccctcgtgtgggtcgcgacgggccagtccttgctgcagaatggcgtctgaagggcccctgatgtgcgccacaaccgggacctctgtcctcctacagtgagggtacacgtggctgtgggccccataggactccttccagaagcatctgcagagtcccaggaccaccagactctgttttgccaactaagcacagtgggcacttggcacctgatgtggactgtctccgagccccctgtggaggggctgcaggcttcctgtgctgcctgtgtgggtcccgcaggctggagggaggcccctgcctttgcagattgcagggtggcagggacacgctgagggtggcggggacatggtgagggtggcggctgtgatggcaccgcatcagagcagctcctccacaccagcgtcttctggggctcagagaaggggttggacttcccagagaaggggtgcagggcagggaagagtccccatgcctatgagggagaggatcagggtggggtgatggaggatccgtggctgggcccccagaccacagggaggctgtgcagccatgtcagaggcgctgggggattgggcggccgcgcggtccccaccccagctcagacccaggggcctgtgttccagaaggtgctcggccccggtgaccccacaggccttgcctgcctccttgtggaatcagccccagcagtgttcgccggcccagggttgggctggaacggtgccatgcgtgtgggagcagctttcccacggaggggccgagccctgtcagctgcttgtcggtgccagcacagcccgtctgtccttggtggagctctgaggcggctctcgcgttagataagacgtctgagctcttgtgtggcttggtaatgctgtggccacctccagtctgcctccttttcgagacttcaggccctcagtttatgctcgccaggtaattcctggtctcgtttgggggccccctccttcccccagaagggaaaagggggctcttcgtggagcgaaggtcttctcttacatctcttttgaggattattgtgcttagaacatggatgattcttggtcaatattcagccgagcccttaatcatcagaagccaaaagaccctccatctctcccaagaggacccctttgactcccaccgttccgtcgctggttcattgaacccacacctgtttctggttcaccacccgccaccgaggtctctgacagcgaggaccaaagcggggtgtgcttgtcacaccttgtttcatccttaccaaggaccccagagcacgagggtcttgttctcatgaagctgagggaggcgaggcgtcctgggtcccgcagcccccaatgcgctgctgaagggcctgctggggagcgggtgggcagcaccgagggccagctttgaaaaaggctgtaccggcttaccaaatccggggaccattttcgtggcaaaagtgtccctcactctgttaaaagaatgcatggtgacacagatttccttcagagccaggtctgaatgtcttccccttggactgaagtccctgctgttagagcgggggagccggcggcgatggcggcgtcctcgtgctgcgctcgtgccggcgtcagggtccccctgccatctggagtgagcaggaggcggccaggccaggccttcccagctgaggtttgggagttccgtgcctttggtgctgagggtgagcgtgttcacggtgacttcgtcccttggtcatgaggaggttcgagctaggaaccccctgcaagtggtcaacgcatccggcttgctgttctaagtggaggcggcaggcacagctgggacccacgcccctcagaagcaggctctgtggtggtcggagcaggcacctcaccaggccacgctccatttggggctgctgagaagctggctgtggccagtcctgaggtctctgcagccctcgggagcttggaggcccggctggtttttctaaggagttggccgggtggccatggctgcccacagtggggtgtgaccttgggcttgtggcctcctcagtgagggcctcctggcaggggctgagagcccagcgtcagtggggggcttcagcatagaccaccacatgtgtgtctctgggtgcttggtaaatgcaccctgtgcttcggtgacaagtttttttgtctagtcaagtgaagcagtggaaatgcagggagcatcttaaatctgttttatttctaactgatttcaattccacctttacccttaggccgaccaagcatctgaggtgccgggacagtaccaccttgccatggggcttcaggcctgctgtgaccccttggggaaagtgagccccatggccacctgcccagttcccaggtcttgtgctgtcagaattcctggtgggccctgagcccagtcaccttcctgtttctgtctacctttgtacattctgtgtgcatagaacactcttggccaacaaagtccagccttgtgagccctggcttgtgagtcttacagcttctctgtgcctgggtcctccagctgaggaagcatcttcagggcgtccccaggcctggcgcccgcccccgtggcacacaccggcctgcgtgtgcttcagctgcttccaggggttccctcacaggcgggggtcagggcacgcacgccaggactccaagtaaactagaataataagctttatgtctcagatacctgggcttttgccggctggcgcgcagccccagaatcagcacctccccatgctcgcctcgtttgtgaagtgggtgctagcacagccttccctggtttaggggtttaggttggctcttgctgtggatttcctagtcccttcgtggcgttgctctttggttccagtaacaggaccagggctaaaaaggcgttgttaaggtgaactgctgttgggtccagtgtggagggacctgaagtgccaggatgcatgctctgctgcgagacagtcaaaccccaagcccacctcaggccccatggttacgctgggtgcatctcccgcaggcctgggagcagcctgcaccccaccgcattggctctggagcctgggcacaggcggccagtccaccgtcctgcgtcacaaccctgcctgcctcaggctgcttgggtgcgtggggaggtggcagggcccagctttctcagcagcccgtggtcgtgccccagcgacgtggtgagtgaccaagctgcgttttaacgctttgtcgtgtctttcctagtgtcggagatgtatgcagtgtgacgccaagtttgactttctcaccagaaaggtgagctgaggccgctgagtgggggtggtgggaagaggggaggggccccaacaggacagctgccgctgccccttctggcaggggacggatgtcatcttatggctcgttttttttttttttgagacggagtttcgctcttgtcgcccaggctggagtgcagtggctccatctcggctcactgcaacctctgcctctcaggttcaagtgattctcctgcctcagcctcctgagtagctgggattacaggggcttgccaccacgcctggctaatatttatatttttagtagagatggggtttcaccatgttggccaggctggtctcgaactcctgacctcaaatgatcctcccacctcggcctcccaaagtgctgggattacaagtgtgagccaccacacccagccgttatggctcattttgagtgtcagccatgccctgtttccgtggaaagtgactgtgctgattctgccggacgctatggggtgggggtgcagcttgcgaggcctgtgcacccacctgccccccgccccctctgccccctccgccccgtccccgtgccgctttgccctcgtgaagtgtcttgcccctaatgtgtgcccagctcatggcgccccgaggcgcgagggcgtcctaagcagtgggacttgggtagttgaaagaaagctgaaaaacagccattttgatccatgattttgaaaaaagggcctcatttcccaggtgaggcggatccccgctgcgtggtggggagcccaggggctggcgacaggaggtgcgcgtgtgcagcggccggcacaggggcctcgcgtttaggcgtggcccggggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggtaaggacgggtgtcctgcacagtcccgcgcgctccgccagccggctcctcgtgtctgtggcgatgctgtgggctgtgcacggggcgttctgcttctctgacgttctctcgccctccctcccttccccgttttcttctggattcgtttagaagcggttatagagccttcccttcttttcagaggcggaatgtcgtctaaaatgttggtgctgactccgctgggcacgtccatcaggtgggaggggaggccctgggcccaggcagcaccttcctccttcccccgggtggaacccggcgccggcgctcgggcgtttgcaaccactgtggctcctcggaggggccggagacctttgcccaatagcacgatgcagacccggttttgagccatctctggggacctggtgtgggagaagggcattctccaggggcatagggtgtgcctccctggaatctgaacaacgagcagcgccttctccccactgtccgtccacctctggccactgccgtcccagcctcctgtcccctgcctgcccgccgtggggtctgggaccacctgccttcctgcccacagctccatcctgtgtgaaacgggcatggtccctggctggacggtgggctttgttgtgcctcctttctgctgtcttggtcctgtcctgccagctcttaggacgtgtgagcagagtggtttattgttctttgatctggaccttggtgatgaattccctgcatcgtttgaaggatgtaaaagaatttctaggagctttgtaagcaagcagaacctgtctagagcagcgcctttgggtttacctcttaaacccttgatccatgactgcctttttgctcagctgaaggggtccttagaacaaagctgtggtttgtttcttgctgtttttactctgtcctctgtgcgtgcgtctcctactggtactcgtgggaagggttaggtggaaaagaagcaggccctgttctcacgtttgcttttgtgttcccaaggagccaccttcctcgtcacgtttggaaactcagagaaacctgaaactatgacttgtcgtctttccaataaccagaggtaagagccggatcctgcttggcacggggcagcattgtcacagaccgggagcctcggtggcactgagcctgagaatgacccgatttggacacttttatttgatgtagatacttgtttctggatggagacagccactatgaaatcgaaattgtacacatttccaccgtgcagatcctcacagaaggcttccctcctggaggtaaatgccagcacgtcctttcctaagccaggagggtttggtgccatgcgtgggtgacaagaggagcatgcacttttgggatcaggcagctgccctgaggagtggggtctgctgggtttccaggacaatctgcctttcctctttcgcggggcgtgtatttactcagtggctttagaactcgccaggtgagtggagacttaaactgtaagacaacaaagggacatttgcctcagcatgtcataatgatttcctctgctctaaatgctctaacgtatcattcggtttattgttggattcaaaccaaggataaagccccaaatgcaataactgagatccccaaaaaggtctgaatggtggctcatcgggagccagcacttcagccctcctcctgcaggcgtctgtgcagactaaacccctggtgcatttcctggtgagctttggcccatcctgggcctctccactaaactctgctgacggggagctcgcatcccgttatctgcaaactgtgctgacagatgcgtgtgccgtaacccatgttgctttccttccgttctctcaccggctcttggttgctccttctcgccactgcctgcccaccttcttgccatagaaaaagacattcacgcttacaccagcctccgggggagccagcctgcctctgaaggtcagcctcttcctcctcaccggggctccccgcatgcagcgggcccgttcctcccctcgccacctggcttctgtccacggggtggtccatgccaaggttctttgtgaaacctgaattcacttactttggttgacttaagagagatgttggatctgataagtgggtttataaagcataaatgaagataccgcagcagatgtactttctcagttctgtctcagcgggagggttacccagcaattgacagctctctgtcagtacctgccagccctgaacaggctgaggccagggggcgtgggggctcacctgcccttgggagcctctgccaacactgcccttccccccgaggcctgctgctccccagctcagtgtggcctcctgggacccctgactctcctggcacttctgtcagcctcctggatggtgaggtgagatgcccaggccagtgttctgtcctgagctcagggatgtgtgtggagccgggatggcatcaagctggttgccttgagcaggctgcaaggtatagatgcccaggtgcaaagggtagggtctggagaagcgggggtcaccccaggcacccctctctgcctgcctcctcctggggagcctgaggctcagatgaaggccagtgtttaggggcatcagatgaaggccagtgcctcaggaggccagggcaacacagcctcccggactgctctcccgggcagaccctccccagggcttctggcactgtgtcccccttgtggtggcttggggggtgcagtgagccccgctctgcccagtctcagtagagcccttcagaccccagcaccctgtcttccggtgggggtggggacaataggaacagtcccctgacctgaaggcagccaaggggccgcctgccagcctgggccctgtagggcaggccacacactcattctttcaaggccagatagtaaacctttgccagccacgtgtgctgtggtgaaggcggaggcggctgcagaagacagggtgacagacggccatggctatgatccagtggtgctttatcaggcaaatgcaggcggtaggcagagccatggtcgccctgctctagagcctaggcaggacgttacactgacaggcaaggttccccagtgttgggggtgggggtgcgtgccctaaccacagaaccgggcttatgaaagtgtggttctagaggcccggcatggtggcccacgcctgtaaccccagcactttgggagactgaggcgggcagatcacctgaggtcaggagttcgagaccagcctgggcaacatggtgaaaccctgtctgtactaaaaatacaaaaattagctgggtgtggtggtgggtgcctgtagtcccagctactcgggaggctgaggcaggagaatcgcttgaacccaggaggcggaggttgcagtgagctgagatggcaccactgcactccagcctgggcaacagagactcaaaaaataattaaaataaagccaggcacggtggctcatgcctataatcctagcactttgggaggttaaggcgggcagatcacctgaggttgggagttcgaaaccagcctgaccatcatggagaaaccccgtctctactaacaatacaaaaaaaaaaaaaaatagctgggcgtagaggtacacgcctgtaatcccagctactcaggaggctgaggcaggagaatcacttgaacccgggaggcggagggtgcagagccgagatcgcaccactgctctctagcctgggcaacaagagcaaagactccgtctcggaaaaaaaaaatgtggttccggggcctcccaggggacagcgtgtcataggttgctcaggcctccaagcacggtcggtgggcctccgactgcagccttggtgcccactccaccaaccggcagaagagccggccctgagtgctgatggggggatgtgtgtctgatggaggggtctcctgagaggtcagtgattgcctacgatggggcttccctcccaagtcatcaagttcatgggaggctgcatcccatgggtctctttcaacaccagccctgactgaagagctgctctcttcagcagtgtattgttggagcgagtgctggaattgagtcattgtcactggaacagctggtcaccgcccaaagacggggagcctgggtcccagagaccagtccccaacatgggtgctgggtctggggagatggcccgtgaccaggctggggtggcatttccctgacactgggcctttgtagtgacaatcccctctgtgctgacgccgcttctcaacggtgggatggctgaggcctctgactcctgggtgaggccagctgtgtccctgaccatctgcttggcctgtcagtggccagggcactctcgaggtggcctccactcttcccccagccctgggtgcaggtgggcacctctgcaggagccagtcttgtctggaggttctctgaaggcaggaacccccacaggccccagggcatagcagcgcctcaattagccgagagcaaggcctctcgtggtgatgtggctcttgttgtttgtcccgggccctggggcacccggctgagtgtcttggtccctctcccaccccacctgtgagcttggggtctcccctcagaggcctgaggagatggtgttccctgggtgctcctgagcaccagccctcactgccaggctactcttggagcagcacaaggttaggatgtgctggccaccgccttggggctggtggccgcctgggcactcagggcctcctttgggccgtcttacctcgtctctctcctccaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggtacctgagcccaggccagggaggctgggccctttggcttagacaaaagcttgcctttcccagaggaagctctgtgtcctgccatttgccccctatccccacaacctgttccccctcagctggggtgcccacgccatctcccctgaaatgcacacaggcttggctccaccaggcacaggaccaagcaggcctcactgtgttgatcttgtctgatctgcaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacggacaaggcctcgccttcctgtgtccagatcacctgaaccctcgtgccacagcgcagtctgggtccagaaagaagactcacagccgccggggtgagacgggtttattgtgcacatttacacagcgtcagcagcgtctgggctggcagcggccatgctcctgtggtcgggctgctctacaagggcgttcacttttcttcaccacactatgtacagtcagtgctccaaggtgatgggctacagtgctgcatcagtgagtctgtacacacatttttacataaattacacacgactcatacatgaaaaatagagcctaagggcctgtattttaatgagaaaaaaaaaatttccaacatagttcgggtagctttgaatggtctagtcaaaaaatacttttggtatataaaaagcctgtacgtacaattcacacctcagtgaagcgccctccttgccttgaggctgggcctgggacaaaggtggcctcacagccagcccaggcagggagatcggcagagaggggtggcccctgaccccagctcctctgccccagctgctgctccttggtggcggcccctcctgacaccaggcgtctgccatccttcaggcaccaaacagccccgtctacctggccctggtctgccctcacaccagtccacccccagccccaaccccaaccaccctccgctgccacggcctccagcacctgactccattcagggaactgaatttgagcttgcaggggtgagaaccacactgagcagcatgacaggctgtgagatcggaggagaagagtatatgctgaggctctcccagttgtcacttggtcttaggggtcctggtgcccgtggcgcggcagtccagccacagtgctgggcctgcacaatcagcctttaggtgaactggaacaggaagcggaacccccaaggcggccgagcagagtgggtactgggaggcatacacactgggcagcaacactggacatgtttccatacagaggctcctttggtgatgaagggaagaaggatcatgtgtgggaagtgtgagaaaggatgagtgtccgattcggtgacggggggcagggcggtcgcaggggagcaggcctcacagcggcggacagtgttcactgctggagggggtgatggcctcggggccaagtcagtaagagcttctgtcttcactggcaaccaaccgggggttatgggacttcttaatggcaagaggggtgggtgttttgaaagtgggtatttatttggatttatagtaattggcaaaattcagtccttggaggcgaaagtacctctcccagttaatgggcaaactggagaaagggcctcacctggaaactgtaggattcacattgtggacgctgtctgctaaagtgagcaccattaagaccattttctagctgcagctttcctggaaaacagcacaataatctcttaagtggctcctggtagctggcaagaccatgcggtgctccaaaaggaagttcaggcgagtgttcgctgtcggggtttgatccgtggatacagctgggaagcaacggagccgcgtcaggacaggaagccacacacagggagcagggccagccagacccgacccctgctcctcacctcagccaccctggacagccgtgcagcacccttgtccctcaggcctacgctcagctgcacctctacactgagacccacccagccctctttaaaatgtgccttgtacccccagaatatcctatttttctcacaacacttcatgccacctaaagacttgtgactgcctgtggctctcaaggtcataagctcccctgggcaagggtctctgcctggctccctgctgtgtttgcctggccaagaacgttggctcaacagcaagcccctggcagctctgcagggcacaaagagagcagaggcagctccctctgccagaggactgagggaatcacaagtccaacacagagctagcagcctgcacgttcccacctctccctccactggagaaatttctaggctgcagagatttctagattggggaaagtgtgggtgggctgagccgggccacttggtgaagttcatcatgaaccgagctcattgagcggcccctcactggggcactcagcctccgcacgggcctccatggcataagcatggctgggggaacctcctggggccctgcctgagcctcatgccagctctgccaagtaggcacctccccctctacagagggggctgctgaggctcagagaagcgaagcctccctccccagccccacagcaggataggaccgcatgctgtacagagacacgggcagctagtttcccagtaagtaacctgagtgctcacccccagcaggtttttgggcacatagccctcccggtctccaaggcgagcccaccaccactcagtctcgctttcgtccttgcgcctcaggatggtgagggcgtccccttcgtggaaggacagctcgtcactgttctgggcctcgtagtcccacagagcatacgccacacctttgttcatcacacccagcttttcctgcacccctggagccagagagcaatggtcaggcctcagcagagggtggcctgcagcaagggaccctgctcgaggaacaggacacagtcgtgctgctgccgaggctgctctcagcaggccccacagaggccagcgagggagatgagacactattgaagactagggcccccacccgatacctcccctgcccggcccagctgctgctcctgctgccggccctttctaagtcctgcaggacagacaggacaaacgagctcctgagccccagggcaagagtgtgctgttcttaaggtgacgcttagcaatcacagccagaacagatttctaaagtcactagctagagcagctgtgactgctcttggatggtaatgaacaaactacacacaactgagccctgactgagcagctacttgtgggttcccaagaaagggcccttctgtgggacactctgcttctgagacccagttgtggtgaccatggggagcttcccttccctgtggtggtgccactgtgacggcagcctcctcctcacactggcgggactcacctgggggctgctgtgcctcccctagccctgccacacagcctgagagtttgttgcttggctctgttgtgggagcttgggccaaagagggcatcacatggctgttttcatggataatttcaaacctagagtccagtgtagggcacatagtatgttctcaagtaatgtgtggaataaatgacttgtgactgtttaatactcagaatagagaagatgttccagctcttggaaaatgcggccctggctaaagcagcttaattaggacatgagcctcattcatcaaatgtttccggggaatggccagggccccaggccaccccaggaaaggagctggccctgcttccagaagcaagggtacagaacatctatgcaaagcacagccaagtcattttgttttcttgggaatctggcacagaatccttctaacaacatggactttcaaacatgttttcaggaatgaaaacaaggggcagtgtgaccttcactcgagtgagacatcctggctgcccctgaagaaggtggaacagctcgagaatgctgtgctgccaggcacggtggctcacacctgtgatcccagcactttaggaggctgaaagtgggcagatcgctggagcccagaagttcgagaccaccctgggcaacatggcgaaacactgtctctacaaaaaaaaaaaaaaagtacaaaaaattagctggctgtggtgggacaagcctgtagtcccagctacttgggaggctgaagtgggaggatcaattgagcccgggaggtcgaggctgcagtgagccatgattgcgacattgcactccagcctgggtgacagaatgagaccttgtctcctgtcttaaaaaaaacaaacagaaagctgtgctgaagcttctctggcaccggctgactgttgccatggcagtaccacagcagacagcaccactgtggccccaggcctcccctgcgtaccatatagaaactgggagcactggatgtagccttcctccatctcctcacacttgtctgcagcagtttcaatgtcgcttatggttgaggcaaaaatggcggcaccactctccaccagctgtttgcagaggtgaacgctgttacaagaggcagcgcagtgcagcggcgtcctggaatagagcgtgggtgaaggtgcaggcctggcactgcctgtcctgtaggacgtggccctcagagatttccctctaaggaatctcgcggaaggcgttcacctttgtgccatcaagtctcagtgttgtttctttaaaggcaggatttccatgagccaattgtttcagaccatacatacattttgaaaagggggcacagggaatgggttaagaaatggccaatccacagatgttcacgccacactgcatggtgatgtgaatgtacataacacactgaaacacacatttaaaaatagctaagatgtgaaattttatgttatgtgtattttaccacgattcaaatgcagcacaatgtcagctgtctgaaagttcaaaataacccccacaggagaccaacacgcctcgcccagcagcagagctcccgaaggcaaacggaatgaacaatgcgacaacctacatgcctgacccagggggatgctgaggctgcttttcacacggagcacagagtgtgaagagtccatacggaacatatgagaaggggaagatggaatgattcacagaatgcttagactgcaatgttaatgacgaggcacagaaagagcataaccacagccacgtttttaacaaaatcatcaagagaaaaggctggaaaaaaaggcaaggaaaccctggcaacagctgtctttcaaggatgaaatgatgggtgttcttgctctaattctctcttccgtgcttcctaattgtctagaacacgcctgttttccttatgcaaagcagggaaagtaaatctgtccaccccacactcctacgggcctcaccatccatcactatcagcagcattcacgttgacaccaaaatccagcaggaacttcacgatgtgatggtggccggcgcagacggcgttgtgcagtggggtgatcccttcgtcgttgggcttgctgggatcttccacctaggacacacggcctgtgagcgcccatcccctcgcccccagcagcgtgcactggtccccggctgcagctcacctcatagatgatcctctgcaccagatcgaactctccttccagagacgcgtctaggagcagtgccagggggttaaaccggactctcagcccgtgccccgtccgctccgagttgggcttcttcaagttggtccgcttgttctgttgggaaggaagcacgctttccagttaaaggtggtccactgaagtctaagaacccacgcctgctgggaaggagtggtgggagctaaagcccaaagacagtggctccgcgaagcagccctggagtggtagcagtagcagcgcccaggtgaccacctcaaataagggccagggccactctgctcactacaagggagagccctgtctgaggcctgagtccctggctcacgcacagagggacacggctgtgtttgagcttctggccactcctcggaagactctgtgggagggagggtggcgtgtgactgccaagtagctgatgggagccagcagctcgttcctgcccacatgcgacagggttcttcctgctatggcaccagatcctagtggagagaatcccactgagggttccctgagatggcgcctggctccctctctgctccgtcaacactgacctcccacccagggcctttgtctagatgcttcttccctcgtctctctacaggaccttcaggtgccagcgacagctccccttcctcaggaaagcctctggagctccctgaccagctgtctgggaaaggcttggccacattgtgcatttgtgtggccgagccccatttgtcatgccttttcatgccccatttgtctgtgtgactgtccgtcctccctacaagacgtaactcagggacatccctggttcccactgctcccagcacagcctgaccaagggaaggaccccagaggtcctggttgcatgaatgaccaggaaggccaggctttggtctagcaatgacacccaccgtggaggtggcaggagggtggctggcagggggaagaggtgctggagggacctgctcttcccctggagatggggcctcagccacaggactcgggatctgctccgtggtggggaccgtggccacgttgttgttattgtcctctgccggctcggcagtttggtgggtggtttggggacagatgagctcctctggttcgggggaaggtaactcattatcattggcatctgatgacggggcaggctcagcggggagtggggctgtgggctgggcaggggggagctcttccaggtttccattggcattggtgtttccattgtccacatcggccaaggtgcccatgaagtcctgggaggggctgggctggtagaaaggggtgccctccatgccaccggccagggtgttgaagcgctggtacagcagcttctggatgttgggcccgccggggccctcgggctctgtgatggagctgcgctttttcaggggccggggcgcgttggccagcttcctgcggagggcctccaggtctgcatcactctggtagcgcagtggcgaatgcacgatgggcgtgagcttggtggggctgagtggccgtggcaggctctccacggtgctgccatctgcgggggcggcggggccatcctgctcaggctctttctcagtactttctgaaggtggctgaggctgtggtgtgcccgtggacagtgacccgtgaagaaacggcagcggcgatggagaggttgaacccgaaggtaaaacgggcttaccatacactggggaagacacaaaggacaggcaattttgacctcactacagagatctagtcatacacacctatgattacaccagagacaggctcctgcaaagacacacatatacatctgctgctgttattcaattctcatttcaaatctctgaggaaacctccccctcttagagcctccactgactccttctgaaaggtgcagtgcctctctaatgtgtcggtttttacatttgggtttccagaactggagctttttcaaaagaaaaaaatagggtgctaacccgacttttcctgccgcagacaagcctgcctgttttctggccaaggaaaaagacaaaaaccactaaacatgcatctgattcttggactaactcacatgacggagacacacgcgcctcctcagagcaggaaggttttacctggaggtccaggagctcttgagaatggtctaagcctttcccaccacagccagaaccctccccacaagggaacactgcaccaccacctgggaggtccctgtgcaggaagtgactaggcacgtccaggaatccctcaactgtgagtctagaagctgcagccaatgcccaggaatgtctaagaaggccctagcctagacctgacccgcggcttcctcccgtaagagtcggaaacaccatcagcctctgtggtaggtgtggaactaagctaccttctctcagctgccttcttagaacatctgagctccataacccaaaccaaggctttcctcccctctgggctatgggggaggctcctacgcagcagacgccctccttaaactgcccatgcccaggggtcgggctcagccactaccaggagggccagtggtcaaggccaccctctacgcactggacagctcccggcacaagttaccacgaaacagaaggaaaagaggaaattctcgacatctcacccttcccggagctggatttcctaagtagcacacggaggtggctgctcagacaggaagtcagagaactgtgagccatctgcaaaacagcctcctccatgcattccagcttccattcccttctcacactgacacccaaggctgtacttttatgtaagaattaagtttaatcctaaatagcacgtggcccaaacgtaaagaaatacattagtattttcttaattaaaagtataatttcctagccccaagaaaaggagagtataaacccactctacctgctttaactgacttatttaaggcgctgtgtgctgccggctggtaattcttaggtggtgtggcttgctggaggtacatggagtatatggaacttgaattcactgtctggggtcctttcctgggagactgtggccttgaccctttatcagccaggaaaggcctaatggccactgtcagtgggagttcaggcttgctgtccccagctggaaatgcaggtggtcccgctggcgggtacgtgggacttggcggtacggaaatcctctgctgaatctgttgtgaggagcctggctggggggtgctgcctgtggcgggcagcagggtgggcctctgtcgacttggcaggcctgcactgggcctgggcaagctgccttccttcctcctttccagggagcttgtcgacccaggacccagaggtgtaggacttgggtatgtcccatagcttggaggcagctgcttgcctacacccgggatgggaggtggcactttaccaatctcgatgccctaagtttaggtgttaagaagaaaaacaaagtcaccctttgaacagttaagaatatttccacccacattcccaagagaatacacagtagaatttgtaatccgtcaaattggctgtgaccaggacttggggcacactgttgagctcattgcctgtctgcaaaagttctgaccgaaaggtgtgtgtactcgtgggctgctcaggctcttagggcccagtaaccctctaggactttgggtgttgtctggacaataacaggattaacttgcctcctgacaagtcataccctttagcttagtactaaggcagaagagagccctgttgaagagcccgcttgtgttctgtggtaaagacacaggcctaccggcttctccgtgggtcccagtgctgagaagggcacaggctggctggagacagtgccctgcttgacagacccctccacgctcggatccttccagtctgcaccggccacctgcactggtttcacggaagagctagaattctgttttaatgttggccagtttccatcattagcttgaaaagaacacagaacttacgtaaaacttttctcaatgtagttgaaccaacctaagaataacactctgccagaaacaaaaacagcactgggacatcccattctgatgcagatccattaaccgagtggtcaaccaccagccacatgcacaactgctgatctcctccagcacccacagacccgtgcacaagaccaagggacgggctctgctggcagctcactgccaacgcccaaatcgcctcaagtgttaccagagactcacgccaaaccaaggctccactggtgtgggcctggggctgcaccctattttaacacaggtcaaatccattgcatcagcaccaccaaacaaaataagcactggcccttacttttgaaacactatttatgaatacaattacatagagcaataaaaaagatttatcttttgacttcataataggtttgacctgtagtactttaattattgagataaaaatttctgccctctaaggtaacttatgatcacaggaggcccgtgcaggttcccactgatttgcgtagcaggaggagcaggctatcattctgttgcagtgattagaaagctggtcatcaaccccaagttttcaggaaagccactgaaatgacaggttctttacagagtattttccaaactgaaaaagggtgcagaagtatccccttgtaacacaaggcccctcacagtggccgaaagtccattataacacaggctcctggttctcttttacaggaacaggtgctgaactgaactaaagtgttcaacgcttccagcgccatcagcaatatgggacagacagaaatcagagggactcttttaggccctcctggcaggaacagcacatccccttcccttatcccatctgccagcacaggcaggaggggataactaagtagcagcaggaaaatcagtggtcctcacaacaacgtctgagccagaactccggactcatagcacatgacgaggaagcttcccggctgcgctctgagcgcctgggcaacacagggcccatcagccgcagcctcacacggcttgctcctaagccaaactgacccgatgcagccgcaccgcaaccccagctgcatacactgctgggctgtgaagttatgatgcaggctccaggcagcggcttctgagacagctctagtcaagccccgtgggtcctggcgaggcattccaaggcccctggaccaactgccatcttgctccacgtggcctggaggatgtgtggccagaaacctgcagcctccccaaggacagggcctgtggtctcagggtcacagggaatgtggctgtccaggtgcttcagaaaccacccagcaacaacaggaagttttatggaaatcagccatagtggggactaaaaagcaattttctcctttcttcagaagaaggcaagaggtacagaaggaaaatcattttatagaggaacaattatcttttagtatgattgtaaaactaaaagcctcataataaactcagaaatatcttaattttgtaaaaacaaacaaaaaaccctccaaaacaaaacccgcgctacgccagcatctgtcccttggtgtcacactctttctaaggatgggagggtacacgtggccccacccagactccatacctgtctgttgaagaaagggacaaattacgtttgtgtggcatctttttcaaatctagatgtgatgagcagacctttgtcagtttggaaaaacaagtgacaggtgattttgtacatattaaagaggacgcagcttcccactaagcttgtcagccaacatacggtttacaaatgggcttgcagagggccgcgaggagccataattaggcccgacgtcgaggtctgacactgtccatgagctggtcactctgggtttactgtggccatctgtgtgacacagaaccaggacagccaacagcaagggattagagtccctgccaggaggcttcacagcccagctccacctctgggctgagctgctgccccgactctgaaggtgagcacaggttccccgtgtccatgactttcatccacagcagaggctaggaccagggcttcgtgaaggcatctccttgctgcaaccccttgaggcagcacagcagacaccaacaaggacgggacacaggagacatttctcaccttggggagtttctcaaaggaagtcagcagagaagtagctggctgtgctaattacctcccactggaaacagacaaatatctactcctaccacagggtggttcaaactataaataacagcttagcagagcaacctgcagttaggggttcatgccaaccccacactttatgtggctgctgagacacggccgtaagggatctgagtgggggcttgtggctcacaagtgctggtgatgctcttctctttcggagttcataacaagacccaagctccccagtgggggcaacagatgtgtcgctgtccctcctgggggccaggcaagagaaaatgaagcaaacaaagatgagcacaaatccaccacaatcccgaaaaaggggctcgaaacacaggcctgatggccagagagtaacagtactgttttcataaacgaaggaatgtttcaatacatcaggacagggattcctgatgctgtgtgtttcagggaaatgtgtcaacctcagtcataaagaaagtcttattgcaaggaagccccaacacttttaatgcactggttgagaaacagactctccatgaacagcttgccctctgcttggcaggggcaccacccatggactacactagaggtccaagtccatcacacagcaccattgtgaggtcaagaccaaaccaacgatgtgtggactttgatcaatgaggacagagcgctgtttgtaggggcagcccctccacttggctggctgtagccgagttgtggtgaggcatccatgccgggcctcagtgtcctcagagtaaataaacctgcagtaagagaggacactcgtgggtcagttttttttgttttgttttgttttgttttttttgagatgaagtttcactcttgttgcccaggctgaagcacagtggcacgatctcactgcaacctccgcctcccaggttcaagtgattctcccgcttcagcctcctgagtagctgggattacaggtgcacgccaccacgcccggctaattttcgtagttttagtaaagacagggtttcaccatgttggccaggctggtcttgaactcctgacctcaggtgatccacccgccttggcctcccaaagtgctgggattacaggcgtgagccactgcacccggcccatggatcagagttttaattaatcatttgtgttttgaaaagccacacagtagagacctctagttcagtaaaaataacttgttttccttttaggattgttaccacaggggaacacagctctccaagcgcctcacggggagactgagcctggagtctgacgatgtgtggggcagagcctcaggagcctgccccaccccccgcccctccaccgcaggccccattccctgctcacaaactctcccccaggaagagggccaggaccactcaccggatttggatcttccatgagcagcatttgaggcaatactgagagactggggctttatagggtcccccagcacaggaaagcttccggcactgggaacctggatataaggccccacagcagcgaccctgcccgatgtgctcagaggggactgtggtgatgacgtgccattcacacggttcagctacaaattgggaagaaatgagagtcaagattctcctacattcaaagaagtcctaagcttagtgcaagagactgccagctcggacagaaagcactcactcagtggttggtttttaggaagcctgtcatctggaaagatcagcatctagaaggggagactgtggagaaggaactgtagcttcctatgagcaattctccgacaacacccacccatctggagctgtacacatgaggagctgatgtgagggcagagcaacttccccgtgatccacatgcagcttccctcttactcaggatactcttcctcccttgagtgggcacagagacactggtcaaatcctgggctctgagcctggcttcaaatcccctctgtgacttactcgctgtgctgcttcgggcaggtgactcagcctctgtgctcacacccgtggagtcgggataagggctgtagccggtactgtctaagccacgtggggcacagtgagcacgtaaggctctgactcccagcaatgggcccagttccctgaaggcagcgctgcctttctcagccaggacacagagccacagacagaggacactgttcacataacactgctcaggaacagaggcgcctggaacagggattctagagaactactgacgtcctcaagatttcaatataggctctaaataggatccataacccctgtgattgtaagattctatatgcatgaggacaggtcatttcggggtgaggggttatggctttcacaattgctcaaaggtacctaggacctttgggtggagacgcatctctgcaaaaatactgacttcttcaaggcgatcccttgaagtgtaggtggaatgaatctagctgtttgtgatggataactttacacatcaccttgactaggtcacagtaaccagatatttggccaaataccagacgacatgttgctgaaaaggtattttccagatgagattaactttttttttttaatttccataggtttttgggaaacaggtggtgtttggttacatgagtaagttatttagtggtgatttgtgagatttagtgcactctagcagtgcacactgcacacaatttgtagtcttttatccctcactcccttcccaccctttccccgagtccccaaagtcaactgtgtcattgttatgcctttgcatcctcatagcttagctcccacttatgagtgagaacatacaatgtttggttttccattcctgagttacttcacttagaataatagtctccaatctggaagagattaactttcaaattggtagatttgagtgaagcagatgaccctctagaaggtgggtgggccccatccaatcagtggaatgccttaagagaaacagagagacgccctgagaaagcgggatcctgcctagagttggccttcggactccagctgcaacatcctccctgggcctccacgctgccggccgccctcacagattctggacttgccaacgtccacaatcatgtgagccaattccttaaatcacatacacacacacacacacacacacacacacacacacacacacacacacacgtgcacgcgcacgctactggttctctttctctaggaagccctgactactacgccattactgaggagcatatgtaagcacagggaaagtgcttgcagcctctctctcacatggcctctttgttgttaatcttgagaaaaaggaaaaccaacatctgaaatcataaagttgtacaaataaactactgatctttaaactcactgtgttgtttttttaaaagaagggcagatttgtaaatgagagactgtgacatccacagaactggaagctcccttctacgtctaccaccctccacacccactccccctaggcaaaggccttcaagcccatgctgcctcctcagagcatctttcagagcagtagaggctaacaagaggacactattctgtcaccaaactatatgcagaagggagatgtgggaagggagtccttgctggtgggtcaggagagtgggtgctccattctcctaccacgagggcagaatgcactcagctctgcattcaggcactgctcccctaatcactgagtgccacaggtgcgagaaagtcaagtgccacatccggccaaagacacagagtgcaggcgcccctcctccatgcaggcggctcagtggtacatgtgctcaccaatgcactgtgagcagcagcaagactcaggactccctgcctgactacagagggtggtaaaggggtataggccctgggaccagggaatagctttcagatggtgcaaccagaatgaagtaacgacctggaaagacacccgtgctgcagttagaaaaagacaaggtgagcagtgagactagtgtaattcctgcaatcccattttcagttaaagttctgtacctttgtgtctttattagggaaaagactggaaccattagcaactatcacctctagagaacagggtggaaaggactttcacattttcccttaaatatttctgtacttaagagatttatcttaaggaatcgactcatgtgattgtggacgctggcaagtccaaaatctttgatactgaatttcaaaggttaatactcattttttcaatgagcatttattcaatgagtattttatcgtattattttttcattgagtatttattcaatgagtattttattgtattactttttcaatgagtatttactacctttaaaattcagtatcaaataaggattttttagaagcataaccccttacatagcattttggtcaagagtttacaaaatccttctacatggcttatttataagaatccttacaacaactcacggggcaggtaggacaaatcactttacagcaagaacatgaggctacgcaagtcaaagaatttgctcaaagtggcacagcttaaaatggcagagtgcggaccgtgacagatgctgtgactccagagccaacagcatcccccagtgaagaggagacagaaacacatggggaggaaggaaggccaggacactgagagcaaggctgcaggctgaggatggttctgcctccacacaccaggaaataaatgagtcactgggagaaggaactctgttctgtcatttttgatggtttatggcctatttatgttttatcagttatggtggatgggggagcatactgctacttacagaagatgggcaatgcttggataaactatctttagtagtttatctcacaaaaactttttcacatgcctgaatttttttcccatagagacgttcacgcagttcactgattcgcttgtccatcatggccacctccatgttgcgcttatttaagagttccttctgctgctgaagttttgaattttgttcctggttaagttggttacgaatctacaaaccacaaaatacaacctttatgatttgtgttaattaaaagtcaaattctcattgccagggagattaaaaaagaaaaagtagcattaagttctcatgtatatttacatgcatgcactgccaccttgtgtggaatatttcacaggtacagcagagataagccaggacagcgttctcatggaacaaagaaagagcaaacatctgtaagcatcttcttcaaagcacacgaaatgactagtgccaatgatgattacaggagactagtgcggtgtttgggactctcagaaactaaaggatgctctgctccaccccatggagctgcttcaggcctgagcccaccacatgatgcaccttactgtggaggcagcaggaaactcaaaaaggaccaaaaaggatggcctgagtcaccaagtgaagcacctttacatcattttagtggcttgcaaccagcattttaaagaaatgaactaggacagaacagaaaatatcagagtgtacttcccatagtaagagctgtcttaaactttcggatgcccacagcactagtacatacacacttccgtgtgtatactcaacaggacgtaaaatgtacttttaaaaactggattgcaggccgggtgcggtggctcacgcctgtaatcccagcactctgggaggccgaggtgggtggatcacctgaggtcaagagttcaagaccagcctggccaacatggtaaaaccctgtctctactaaaaatacaaaaattagccaggtgtggtggcatgtgcctataatcccagctactcgggaggctgaggcaggagaattgcttgaaaccaggaggcggtggttgcagtgagctgagattgccctactgcactccagccttggtgacagaggcagactctgtctcaaaaaacaaacaaacaaaaaacaacaataaaaactgggttgcaggctgggcgcagtggctcacgcctataatcccaatactttgggaggccaaggtaggcagatcacgaggtcaggagttcgagaccagcctggccaacatggtgaaactccgtctctaataaaaatacaaaaattagccaggtatggtggcgggtgcctgtaatcccagctactggggaggctgaggcaggagaatcgcttgaaccctggaggcagaggttgcagtgagccgagatcgtgccactgcactccagccttggactccgtctcaaaaaaaagaaaaacaaaacaacaacaacaaaaacaaacaaacaaaaacctggactgcagtccaaaaagttggaaataaatgacatccttatattacactcatcacatttcaccaaaaaatccttaaaacgctgcacttttaacaatcgcttaaaatgtagaagtcatgaaaccttataatactgtagtacttctatgcatttacgttaaagaacttaacagcaaccacaagtgattttactctatgtagttaaataccctcatttcataaaatgatgtaatattttttctagcaagtgctaataaagcagcaagacctatttctggcttgaaaaatcgcctgctgaatgacaacttctgagacatgaaaatcttaaggattgttaaggactgaatgtgtcccccaaaatctctatgttgaagccctaaccccattgtaatggtgtctggaggcagggtctttaggaggtaattaggtttaagcaaggtcatgagggtggggccccccatgatgaagttcacggagagagactacaactctctctccactacgtggggacacagcgagaaggcggctctctgcaagccagggagtgaacattcactggaaactgaatttgctggcaccttgatcttggacttccagcctccagaacagtgggaaataaatgtctatagtttaagccatccagcctatgatattttgttatagcagtctgagctaagacaaagatttaacaataggcacctagctcatcaaaagagtttacacaaaggccttaaaatatcaccctaagtttaattctttactggattattatctgctaattgaattattttgtgctgaaaacatcctaagtgaaagaagccggtcacaaaggaccgcatacagggtgtgttttggttaatatcctttaaccaaaatgctggggacccggagcatttcagatgttggattcattcagatttttaaatatttatgttatatttacctgtttagcatccttcctaatctggaaatccaaaatccaaaatgctccaatgagcatgtatttcctttgcatgccacgctggagctcaggaagtttcagatttgaagcattttagattatcggattaaggatgctcaacctgtactgcatgattccattcatatgaaacgtccagaataggcaaatctacagagacagaaagtagatctgtggctgccaggctctggagggtatggaggttgtggggtgatggctaagaggtgcgggccttttttttgggtgataaaaatgttctaaaattaactgtggcggtggatgtaactgacaagtcggtgaaggtactgaagccactgaattgtatccttgaaatggatgaattgtacgctgtgtgaattagatccttttttttttttttttttgagacagagtctcactctgtcacccaggctggagtgcagtggcgcaatcttggcttactgcagcttctgcctcccgggttcaagtgattcttctgcctcagcctcccaagtggctgagactacgggcatgcgccaccacgcccagctaatttttctatttttagtagagacggggtttcaccatattggccaggctggtctcaaactcctgatcttgtgatctgcccgcctcggcttcccaaagtgctgggattataggcgtgagctaccgcacccggcctatcccaagtcatttaaaaaattattttgtactgaatatatcttgtgcctattattaaattagaatctactaatttgtttccacttcctaaggtttccaacccatgctaatgaaagatagaaagatgagaatgttttaatacaaccattgccagacccaggagttacctgtagttcttggtacagtctttttaactccaccgccgctggtcccgtcaatttgccattgtaagactggaacccattcagttttcctttctttaaatcttccaattgctgactaagctgatcaacccttaaaattgcagtctgtacttcctgcttcttttcctggaacatggcactgaacctttctatttcagcagctataattgaccacacaagaaaagaataaaagatttagttgatcctttttttttttcatttctatacactgaacttaattctagtatcatttagtgccagaccgtggagaaagctgtgatatgcagaatccacaacacatttcaaaaagcctttgggacacatgtatctgattactcataaagcaaacaattatatttgcattaattcccgactattctttagggtaatcagtccataagctagtttgttcaagtgacttagaaatctctgagaccaaaggttttgtgaaggcagggccatccaagcctctctcgtgcatcactgtgacttaaagtaggcacagactgaaccaatgaataaaataagagttcatacagaaaaaaagtgagcatcagcataacttatcttaatgcacggatacaagttaagttattcaagaaaaacagaccctctgaatgagtaagtcttggagcgccccaccctaatccaaagggccgctggtaccaacgtaacaagaggatttttctactgcgtctgagggccgcaagagatctttttatttttttttgagacagggtctcattgtcattcaggctggggagcactggccggatcgtggcttactgcagccttgacctcccaggctcaagcaatcctcccacctcagcctctcaagtagctgggactacacaattttaagatcacttaacctaacccacccatccttttagatgcaaataacagagcaaaacttgagcacgcttgctatttagtcctgtgaatttgtgactgaattgtcaggcagttagactatgtttcactggatctgggcctggtgagagtggtgtcgagggggtgttgcaggcacgtacacagattgccgttcatgattttgctgtagtcgacttgtcctctcattgcacgaattttcttcagcttgttctcctgggcttcaactcgttctttcaatttctgaagcttttcattttcagaaatagactgctgctgacggcgctcctgttgctttagaaaatgtaaacgctgttcctaacaaaagaaagaaaaatgtaactttgaaaattgaaggctgggcgcggtggctcacatctgtaattccagcactttgagaggctgaggtaggtggatcacctgaggtcaggagttcgagaccagcctggccaacatggtgaaaccctgtctctactaaaaatacacaaagtaactgggcgtggtgtgcgcctgtagtcccagctacttgggaggctgaggcagaagaatcgcttgaaaccaggagatggaggttgcagtgagctgagatcgtgccactgcactccagcctgggtgccagagtgagactcagtctcaaaaaaaaaaaaaaaaaaaaaaaaattgaaacttatgattacttttatatactcaaaaagaaaaatgtgagagtattctacagtatcactcatcttaaagaatactaaaacactagaggaatcttatatcagaccataaaaaactgaaattactgggcgtacctaagtatgaaatagtaagagctgcgggatttttaagagagagggttttctttttcttcttttttttttcttttgagacggagtctcgctctgttgcccaggctggagtgcagtggcatgatctcggctcactgcaagctctgcctcccgggttcacaccattctcctgactcagtctaccgagtagctgggactacaggcgcccaccaccatgcccagctaatttttttgtatttttttagtagagacagggtttcactgtgttagccaggatggtctcgatctcctgacctcgtgatccacccgcctcggcctcccaaagtgctgggattacaggcgtgagccaccgcgcccggtgagagagggttttattacactcatctacaccagttaatataagcgcttctgcagaaaaccttccagcaggagaacatgcactaacacagtctcctcttcactctatcacatccgtgatgttccagtgagccttactttcctggtgcaagtaatacatttcctgctgctacaaagtggcttccaagaatctaattcatttcctaaaggaaatgaacactgaccagcagagaattttacactgaaaagagataaaggtgatcagtaaagagataaatcttcaatttgttgtgatactgaacaatcaaggaagtgtctgcttcttcaggattattttcttcaataaggaaacattttagagtcaaacaataccagaacaatctaaaaataacaatatatgcaacattcttcaatagggttttccctattaatgtgaaaacataccttaaagagtcaacattaagtattcatgatcccatatgtatgcataaaatacacctacatagggagaggtttaaggtgtgattatgaaggcactacatactacactctaaggtaaaacaatatgtgcttaaatatttaagatgtagcattaacttgtgattcacattactgaaaatatctataactattttgaacagcaatactcttggatcaatatttggaaaaaaataaaaagcagaattagaaaatttttacaatgacataatactatgtatattttatcttagaaatcttattaatgggataaagtactttccaattgaacttaacttttaatcattttctcataaatccaataaatattgagacaactttttaaaacaagtccaacccaaattattatttacataaaagtggatagtacaatgaagtatatacagtcattcaataaattttaaaaaatcagattggacattttagtcataaagaaaatctctctacagaagaaagcaataagaacctagttggtaatgtttaaatgttatctttaaagccagtttggaatttttttttctttttttttttcattttgagacagagtcttgctctgtcacccaggctgcagtgcaatggcgcgatctcagctcactgcaacctccaccgccggcttcaagagattctcctgctcagcctgagtggctgggattacaggcgttagccactacatctggctaatttttgtatttttagtatagacagggtttcaccatgttggccaggctggtctcgaactcctgacctcagatgatccacctgcctcggcctcccaaagtgctgggattacaggtataagccaccacgcccggccagtttcagaatattttaagatcatttacaacatgaatcatttccagcaggcatgtgtgatacatctgatgtttcaattaaatatgactaaaccattacttagaaagattcgagtttcaataaccagtgtagaactcagtatatataataagcattatctatactccgcactgtaataaaccaaacaagtccagcctagagtagcacatggggaagccccgttaaccacctgtcattgtcttcgtggccctgatcagtgttttcatcacggattgctgctttcttcttgaacattaataccaatgacacagccaagaacatacccagaggcaaaaggagataacaaaagcaccctttcttcccgatttctttgttttttttttcttttgagatggagtctcgctctgttgctcaggctagagtgcagtggcacaatctcggctcactgcaagctctgcctcctgggttcacaccattctcccgcctgagcctcccgagtagctgggactacaggcgcccgccaccaagcctgggtaattttttttaaatatttttagtagagacggagtttcaccatgttagccaggatggcctcaatctcctgaccttgtgagccgcccactttggcctcccaaagtgctgggattacaggagtgagccactgcacccagcctttttttttttttttaatacagggtctcacttactctgtcacccaggctggaatgcagtggcatgatcttggctcactgcaaccaactcctgggctcaagtgatcctcctgccttaacctcccatgtagctgggaccacagccacatgccaccatgcctaatttttactttttgtagagacagggtctcactatgtttcccaggctggtcctgaactcctgggctccagcaatcctcctgccttggcctcccagagtgctgggattacaggcaggagccactgtgcctggcccctttccaaattttatctatgattttaataaggtcatcagtttcctgtttggggtgtctattgtatgtgtcaaaagtgagatgctcttgttctgatagcttcccaacttccagaaactacagtatgcatatattattatggaagtgataacaaagagagaaagactgcatttagcactcctatggcatggtcctattttataagcgttacccaagaatatattaaccccagtctaaaatgatggttaaagaaggtactttttgaacaatgtttcaatacctctttttataacttaccttggcaaccaacatctgctgctgattttcaatctgctgctgttgcctagctgccatatcttggagctctgagagggtaagttcaacacgtggattcccaacctaaacaaaaagcacttattttggaacataagtttatctgcataattgtctgtctctagtgtcaaaactcacacatatcaggactttagataggatccctagtagtgaggagagtaccaactagtttattttcttgtaagaacttttcctaattgttgactgcttttatgaaatataaataactgtttttctaatgcataaacatcagataccgtatttagtaagggctcaagtttaagcaaacatttgcaaatgtgtattatgagtgacattcctccttctggaatgacaatttagtaggtatatttgagcaaatggggctgtcaaatgtttaaggatacacaaccaaaaatataaatatgcaggtaacgcctaagaacaaatgtcatctcactatcacctgatctcaggaaatgaaaatacgtaacagattctaatatatgaataactcactaaaaacaccatatgcatgacttacatgaagaacacatcatccgagagaattacatatgtgaaatcaacatgcaaagtaacatctagatgaatgcagttggctgtttctccattctccaatctctgtcaatgatgccctgaactaaacactttacatatatgacccatttcggcctcagaatgaccaatgaggtgggtactgttacatccctgttttacagataagaaaacaagcacagggcagtcagcttgcgaggcaaagcagagacacagagtctatgttctcgactgttcctcacagttcattacttactaagcccacaccacgtgcactgtgtactgtgacagacatgctatgagcattgtgccatatgctcttcaaaacaaatctgcatggggttgtgggggttatgtgagcccccactctgggtgaggagctatgggggtgaggggaaggagcatgcctagaggcacgcagctcattaaagccctagagctccattctcacaagcccatctccaaacccttcagttctgagcagggaggccacacagttcctcctcaagctcccacgttctacttctaggttcatatatactcttaggataccttcaccttctgccacccttaaacctcttataattcttaatagtcagttacagttcctgttcctccagctccatgtcttcccaaacttttatgatgtttgagcacattcttgactcttgaaacatgggatcaggatttaacagtctttttttttttttttcttgagacggagtctcgctctgtcacccaggctggagtgcagtggtgtgatcttagctcactgcaacctccgcctcctgggctcaagcaattctcctgcctcagtctcccgaatagctgggactacaggtgcccaccaccacacccggctaatttttgttatttttagtagggacagggtttcaccatattggccaggctggtcttgaactcctgacctcgtgatctgcctgccttggcctcccaaagtgctgggattacaggcatgagccaccgcgcccggctggatttaacagtcttaactggaaccaccattctgtttatctaaaaatcctgaaaaagcaatacggtacaagattttttttttttttttttttaatttagagactgaatctcactctgtcacccaggctggggtacagtggtgcaatcactgcagccttaagctatcctctcgcctagctaggactacaggcacaagccaccatgcctggctgatttttaaaattttttgtagaggcaggggtctcaccatgttgcctgtgctggcctcaatctcctgggctcaaatgatcctcccacctaggcctcccaaagcgctgggattacaggtgtaagccactgtgcccagacttaaacactttttgactagagtaaaactatgtctattcaacaaatctttcaattaacattaattttataatttcacaacttgaagaaaaaaaaaaatcaaaaactacctttctggtctcccccaccaaaggcttcacaaaacaatgaaaagaggatagaagagaaatttaactgtctggtgttctgatgtttatatctatgaataagatagagcttattaaaatattttacttacctaaaccaaaaagtattttatttgccaatacatacatttatactctttatgttgcgtgtgtttttctaagtacaaaattaagatacgccatcttgtcataggtaattcattgtatcttatacatcaacttataatgtaatgaaattttatggaagatcttacatatagaaaggtgtaataaatcattatgtacagctgaatgaattatttcaaagtgaatatgcctgtgtgatttaattgtatttaaatgggttataaaaacataagctaccataaacctgtaagtcaacaaatatgtaacaatttacatttcagtaattgtgcaatgtgaaaatttgggaaaaaagaagcactttttccacaatttcaaagaaaatgaaaactcttcaatgcaaactggattttttaataataggcctatcactgtattacatgcaaactatccctacttacaattttaaattttttatacaaactcaatttattcaaacaaacctattacctaattcttccctatttctcttcattgattgcatctaataagaagaagtcaaaccctgttccctcaggcaattcaaggtccctaattatggtagagttgtcggatgagttcagctccaggtcacacagtgcacaagccacttccaacaactaagttaaattagcagaaaagttttctcagcaacagtcaggcaggtgcctacaaatacgggacccccaaaaaggaaacatcccaccagccttaaacctgctccgatgatcccttcggcagggactaccacctgtggccccagggatccagatctcctccaacaccgatgttcactacctgaactctgggttccaggaacactgtttctgctactcatgaacccagctcactctccagcctcacggcaacatcacttgttttccacaataaacacggcccaccccgcctcaggtctagctagcctcccaccctgaccccagcatgagcagagggaaatagtttttattatcacttatctgatcatatcactgccttctttctccaaacttccacaaatctacttgcagaaataagagacttcattagctggcttacaaaatttttataaacaaaatatttgtctctccaaatattagtaataaggctagtcttacattctatttaatgtactattgaaatattttgctaatatgtggccacgcatgatggctcacggctataatcccagttcatgagtttcagaccagcctggacaacacggtgaaacctcatcactacaaaatacacaaaaattagccaggaatggtagcgggcacctgtagtcccagttacttgggaggatgaggtggaaggaacgcttgagcctgggaggttgagaatgcagtgagctgtgactgcaccactgcactccagcctagggaacagagcaagaccctatatttaaaaaaaaaaaaaaaaaaaaaaaaagaattttgctatgtgccaaaaagtagtaaagactacaattttacctatgaacagaggaattcatcatattacataccttatccaatacctgtccagttaatgactcttcattattgcagttcttgaaaaactatgccatttctttttcgtataattagtctttcacctagaagcactacataggccgggcgctgtggctcacacctgtaatcccagcgctttgggaggccaaggtgggcggatcacgaggtcaggagttcaagaccagcctggccaacatggtgaaacactgtctctactaaaaatacaaaaaattagccgggcatggtggcaggtgcctgtaatcccagctactcgggaggctgaggcaggataatcgcttgaacccaggaggcggaagttgcagtgagccaagaccgtgccactgcactccagcctgggcaacagagcaagactccatctcaaaaaaaaaaaaagaaaaagaaaaaaaaagaaacactaaataatgctctataaggagtggtattttgacattacaatttcaggcaaatatacatactaatttagtcaacccaattgttcctagtcagagaacagactctggtacagatttgaattttgtgtcatgcttggataaacccaaaatattctgcttttgcttggcatacatatgccaagtgcctcagaggcaggggagcatcttcgacgcctgttttgttgtgcacatgtgctggctctacctgctctgaagtgctctcttgtttagcttttgtgaccctgaagtgctttcctgtcctataactttatttttattataagttcagtcacagtgcaatctccccaaacagcatcatcataacccagagaagagagagaacatgtatatgtttaaaggagctaagctacagcataaacgatggaggtttaactatgaatggtgctttttccttcaatgcctaacatacattcctttgtgattacaaaatcagttaatagaaaagactagtggattttgtcagcaattaaacatctactggcaaatgggtcacttcagatgtccctaatcttgatatgctgattttaatattcagccaaattacttcattatggttataataggcaagaacatctcacatcggggtctgttgtggggtggggggaggggagagggacagcattaggagatacacctaatgttaaatgacgagttaatgggtgcagcacaccaacatggcacatgtatacatacgtaacaaacctgcatgttgtgcacatgtaccctaaaacttaaagtattaaaaaaaaaaaaaaagaatgtcaccataataatatttggaataggcagccactgctgcagcctctggaagcctgaaaaacgggaaccaagagcaagagaacgactcagtccctgggtgtcggcggtggccgtgggggtgagacggatgggggtggaggcgctgctgctgtgggggcaggtggtggcggcggccgcccgctccagccatgctgaataaaaacaggaaggagaaagaatcaccaaaagcagggaagagtggaaaaagttcaaaagaaggacaagacacagtggaatcagagcaaatttccatcaggacaaacagccttgttgctgtccccgtctacagtatctgctaaataaaagtaccagcctctcagcccatagtgaagaaagacaaacggcaaaattcttcaaggtttagtgcaagcaataatagagaacttcaaaaactaccatccttaaaagattcgttgtcaccagcactttgtgaaggttcctggggtggcctgcagcagcttttcccgcagctccctcacactgccaccttatgacagggataatgagatggacccggatttcagaaacaataaaatgtggaatgtgtccatgaaatagggttgaaaggttgacttggaactcagtgggcctgttgcttttctctatgaaacgtctgtagcttcttagcacagtgcgtccatttagaaaggggggtctgttaactagtacatggtcattgtttaatgcaccttttaatctcttccttatcagtggcggttatgtctccttataagttcatttattcttttgactgttctgtttgtgttcagtattattcatctgtacttttatctttaattatcctatgtcttttattttaaccttttcttcatttattaagttgaatagagagttgacttatttttagtttgctttttaataataaaagaatttaaagccacgtattcattctgagtataactttcagccctatccctagattttattttttccttaacttttcgagtcacaggcttttcttttttagagttaactgaggcataatttacatatcctaaaattcacccattgtaactggaaaatttagttattttagcaaatacatagagttgtgcaaccatcaccacaactctgttttagaatgtttccatctgcctccaaaagttacctcatgccattcaccattaatttccactctgggccccagctgcaggcacccactgatctgctttctgtctctagacttactttcttccggacgcttcatataagtgaagtcataccataggtagtctttcacacctgctgtgaggtttttgaggttcatctgtgttgagtggtttctttttaatgctgcatcatattcagtcagatggatacaccacaatttgtttatccattcaccagttaatggacatttgggctatttcttagctggtatgagtaacagtgctgctgtgcacatttgcatagaagtctgtgcgagcagatatttcatttctcttgagtagatacctaggagtggaattcctggcttgtatggtgagtttatgtttagctttttaaaagactgccaaactgttctccaaagcgattgcactattttacatttccaccagcaatggacaccagtgtgtccacattcttgctaatatttgtctttttgcttatagcttaattcttgtggatgtgtaatggtgtctcactgtggtttcaatttgcgtttccccaatgactggaaatgttaagcatcttttcatatgcctgttagccacttgtctctcttctttgatgagatgtctatttttaagttggttgtcttcttcttgttgaattgtaacagtatgttatcccagatatgagtcctttatcagaaaatacaatgaaaataaattattatagaagtacaaaatacatccacaatgttaattattgtagtcagtagacataaaattaccctgttaagttgatatgaaagtttcaaaatgcttattctcaatttctgttattcattgcaaatcttcagatttgtctatatgtgttaaacatttcttttgagcttttaatttcagggtttttttttcatttgtgaaagttctgtttggttcctttttcggtctgcagtgccattttaaaatattttcctattctcttgaacataccaacaaaacttgtcatttatttaaataaagtaaatacagctgtttttttttgttgttgtttgagatggagtctcgctctgtcgcccaggctggactgcagtggcggatctcggctcactgcaagctctgcctcccgggttcatgccattctcctgcctcaatctcccgagtagctgggactacagacgcccgccaccacgcccggctaatcttttgtatttttagtagagatggggtttcaccgtgttagccaggatggtctcgatctcctgacctcgtgatccgcccgcctcggcctcccagagtgctgggattataggcgtgagccactgtgcccggccaacacagctgttctatagcctgtgtcaggtcataccagtatctgaggtgtttgtcacattttgttcgtgatgtcttatttccttgtgcacgtgatttttaaaaattgtatactggtcattgtattcagattatttgaaataaactgtaacctagaatcaaaaaaatatatattatttggaataaaaaattccctaagctttcaagctccagtgagatgacatgaaatagttcaacagtttcatgctcgttcctttttgcacttagtttataggagaacacaccttgccaaaacatccacttctggcctctctccaccaaactcctctctctccttccaagcctggcttcctccctaaattccctatttctatgaatggctctcgcctttttccagaagcctcagcagcaacatctttgattgagccatccttgccctaaataaaggctgctgctcgaaagtgctcttcatgacctcccacatctgtgcttgccactccgttctagaaccaacactttcctgtgagcatatttcactcatgctcttcccgctgcccacagtgcccttcccccactgcttcctaaactctgcctatcacttaagacctaggaggcaatgccatctgcttcctgaagttcttcctgattctttaaggactctctcataccattgttttgatattcaggatgtttattcactttcagagatgggaagaactcagtactttttaaaatgaattcttgaattcattctagagattcagcaattaacatgtaatgaatgcctgctgcatatcagacatttacatatacccaagtttacagttgtcttagatgatgcttacaaaaactctcggaggaaatttttattttattattattattattattattattattattattattttgagacggagtctagctctgtcgcccaggcttgagcgcagtggcgccatctcggctcactgcaacctccacctcctgggttcaagcgattctcctgcctcagcctcccgaatagctgggaccacagacgtatgccaccatgcccagctaattttttgtatttttagtagagatggggtttcaccatgttatccaggatggtcttgatctcctgacctcatgatccacccacctcggcttcccaaggtgctgggattacaggcgtcatccaccgtgcctggcccctaggaggaaaattcttaagcttattttataggtgagaaagctaaggctctgggcagctggttgactggctttcccacgcttaagtgtcaggtcagtagcagtgccaggatcctagccacatctcctgacagcaagcaggcactctttccatcacatgggaggtgatgccctcaccacctggctgcagcttggtatccgtggttgctcctaatcaacagccatttattatgtcaaagggtaaacacgctaccagacaccatgaagacatcttaataatctaaatcatatgaaaatactgcttttttgtttgtttttttcagacaagagtctcgctctgtcaccagctagagtgcagtggcgctatctcagctcactgcaacttccgcctcctgggttcaagcgattctcctgcctcagcctcccaagtagctggcactacaagtgcgtgccatcacgcccagctaatttttgtatttttagtagagatgggtttcaccatgttggccaggatggtctcgatctcttgacctcatgatccgccagatcaaaaaatgatcaaacatcaacaatttcacatagttcgaactaatgggaaaggattaatttctcccccttgaaaaacataaaagttacttgattcaagaataaaacaattttaaaactaagataaaggcaataatgagaactctataggcaactctttatttttggaagattatgagaagtgaccaaatagacctaatgtcacctgcccaatgacccgaagggctttggagtggaaggatcacttgaggccaaaagttcaaagccagcctgggcaacatatgagacaccatctctacaaaaaaatttaaaaattgctgggcatggtggtgcacacctctagtaccagctactttggaggctgaggtgagaggactgcttgagcccggggttccaagctgcagtgaactatgattgcaccactgtactccagcctaggcaacagagcgaaaccctgtctctttaaaataaataaataagaactgaaaatctataaattaccatttagaagaaaaactggatgccttttctgcttgtatcaccatacccttgaaactgtattttcaaatacttcctttgaaagtctctgagattccaggagttgtgacaccattgcaaagcacagcaaacaatgacctcacaaggctcgtctccagtctcattcccgtcctgctctttatctcccactgctgatatataattcttgcaggccagcaccacagagatctttctaaaacacagcttgcttaaaatcccacaagattaatctgagctcttagcatggtgaagacctggcctctcccaggctggtcctcttgctctcgctctcctccctctccgtgtcccctctcagtgtctcctcccccttgcctgtccctacacttcatgctgcacagtcctgtttataactctctgtcaccatacagtttcatgtctattcctctgtatctttgtggaatcctctgattctttcttttgggaagtattgcccaacatcaatcttgataaagttaatcatacccctttattttggtgccttattccacttttactacacttttcatactagcatgatttgttcacacatctgtctccaaaaatgccctttctttctctataaaatctgagaggagacttcaggtggcctccactaaccatcttgcttttgtgtctttattctgtctacaattaaaataagttgcatagaattgttttaaaaataatagagaaattctaagcctccgtggtagtcacctgagtgtcttcttttttttttttttgagatggagtctcactctgtcacccaggctggagtgcagtggcacaatctcggttcactgcaacctccgccccccggggttcaagtgattctcctgcctcagcctcccggatagctgggattacaggcacccatcaccacgcccagctaatttttgtatttttattattattattattttttgagatggagtcttgctctgtcgccaggctggagtgcaagtggtgccatcttggctcactgcaacctccgcctcccaggttcaagcaattcccctgcctcagcctctcgagtagctggaactacaggcgtgcgccaccacgcccggctaattttttttgtattttagtagagacagggtttcaccatattggccaggatggtctcaatctcctgaccttgtgatccgcctgcctcagcctcccaaagtgctgggattacaggcgtgagccactgcaccaggcctaatttttgtatttttagtagcgacagggtttcaccatattggccaggatagtctcaatctcctgaccttgtgatctgcctgcctgcctcagcctcccaaagtgctgggattacaggcatgagccactgcaccaggcctaatttttgtatttttaggagagatggggtttcaccatgctggccaggctggtctcaagctcctgacttcactgatccaccctccttggcctcccaaagtgcaggattacaggtgtgagccaccctgcccagctctcagtatctctttaaactgtacatgttttatacatgtacatatatttctgtgtatatatttcacaataaagaatagaaaaaaattagaccaaatgtctagtatcttatcttgtaatttaatcatcacaagatttaaaaagactataaatatttttagcagtttacagaaaatgtctttaaatttgtctttgttttacttccacactgcactgatcttttttctttctgttttttgagatggagtctcgctctgtcacccaggctggagtgcagtggtgcgatcttggctcaccgcaacctgtgcctcctgggttcaagcaattctcctgcttaagcctcccgagtagctgggatcacaggtgcgtgccaccatgccaggctaatatttgtattttttttttagtagagacggggctttaccatgttggccaggcttgtctcaaactcctggcctcaagtgatctgcccgcctcagcctcccaaagtgctgggattacaggtgtgggccactgtgcttggcctacactgatgtattttaaaattttttttttgtagagacagtgtctcactatgttacccaggctggtctcaaactcctagtctcaagttattctcttgccttggcctctcaaagtgctgggatcacaggcgtgagccacaacacatactgtataactagttttttttaaaagtataagcagtttctcaagtaaaatgtcatttcaaaaatgacaaacatccctaatgcaaaactctagcaaaataattagaataaaacctacttatgctcacgtaatattcatcagtatgaaatcattcctctttgttcctatctcttcaaggttatatatcttctggtttgaagagtaggttttacttgcccatttagcaaacaaaaaataggtgataatgatatcaagataccttatgaacacggatgctcatttttatcacataaattatatgctcagtattcccagtcacaaaggtggcaaaaatataaaatgttcaataaaatcaagcctctctaacatctcattaaattctgaagccagaatatttcatattccaataattactaagtctcacaaattaataagagccaattagatatctaaaatgcatactagctccctatcccctgcaatagtactacaacatgctattttagtctataaatgtgaataacttttttttttttttaaacagaaatgaggtctactctgttgtccagactggtctcaaactcctgatctcaagtgatccacctacctcggcctcccaaagtgctgggtttacaggtgtgagccaccacgcccggcccaatatgaataaattttaatcataagacttattcacataaggcccaggtggtagctcatgcctgtaataccagaactttgagagactgaggcaggaggatcactcgagctcaggagttcgagaccagcctggccaacatggtgaaaccctgttctccactaaaaatacaaaaattagccaggcgtggtggcgcatgcctgtagtcccagctacgtgggaggctgaggcaggagaattacttgaacctgggaggcagaggttgcagtgagtcgagattgtgccactgcactccagcctgagagacacagcaagacactgtcttaaaaaaaaaaaaattcatccatatccattcaattcaatacacatttatacccaaggcaagatgctaggaataattagggctagaaagaaactggcaggaaaatgggctatcaaagtgcacagataacaacagaaaacgcatcccatgccacatgagaactatgacaacaccctgggagcgctctgcttccaacctcatggctgacaggacaccctgtatcacactcctggtaacaacacctaaaaggcaagataaaacacaaaacatgtttttaaaagcatcactgagttggcacaacagtaaggaaactacagggaccaaaaataaagagaaaccagaaaccttgggcaataataaaagaactccacagctggcttttgtcctgaaggtttttgcccacctgcatacttgctccctggcagctggtgaagtctggcattaggaggtaaagacttaagctcattccattgtggagagtccaagaggagatgcccacaaacgtccaggatgcgaagacctacaacctcaatgtaaggctaactatgaaatgaaccccccaacagaagggggcagtaaggaacctacctttctctatcactgagtggaaggagagacggccccctaactatctgtaaccactagacagctctcatgaaagcgtcatgatccacaaaaggacagtagaaattgagcctagcttgtgcctagttactgacaaaggcctttcaggaaaggcctgactttatccaggtgtcaaaaaatgcccagaggtaaagttccaaggaaaacgagcagctcattgtcaaaaaccaaaacacagagcaatcaaggagccaggactcaacagtcagcagaagtcacgttcagattgagaaattattagttgctgaacataaaatatgtttagtgtgtttaaaatgtaaccaaagagcaactaagaagatttaagaactaacacttcttttttttttttttttttttttgagatgaagtctccctcttgtcccccaggctggagtgcgatggcgtgatctcagctcactgcaacctccgccccctgggttcaagcgattctcctgcctcatccccctgagtagttgggattacaggcgcctgccaggacgccaggctaatttttgtatttttagtagagatggggtttcaccatgttggccaggctagtctagaactcctgacctcaggtgacccacccaccttggcctcccaaagtactgggattacaggtgtgagccactgtgcccggcctaaaacttctagaagtgaaaattttaatgaattttacaacagctttactgaggtataattcacatataataaactgcatatatctaaagtacacaatttaatgttttgacaaatgtataaactatgaaatcagcacaatcaagaaaataaatccatcctctccccaaatttccttgtgcccttttgtaatcccttcctcctatctctttgccccccactcctggttctcatatccacaggcaaacactgaccttccctgttactagagattatgttttctagaattgtatatgaatgaaaccataacagtattcagtatgtaatcctttggctggcttctttcagcacaatgattttgagattcatccatgttgtagcatgtattagtagttcatttcttctgattgttcaggaatattccactgtgaggatataccatagtctatttgtgcatttatctgttaacgaacatttgggttgttgccagattttggcttcaagccaaatcaaactgctatggacagccatgtacaagtctgcacagacatttgcttccatttctctaaggtaaatatttaagagtagagttgttgggtcatacagtagatttatgtttaagtttcaaactaccaaattattttccagattataccattttacattcccacaagcaatacataagagttccaatttctccctttcctcaccaacacttgttatgatcagtctttttaacattagacattctaataggtgtgtaatgccacttcatggtggttttaatttgtattttcctaaagactaatgatggtgaacacctttccatgtgcttacttgacattcatatattttatttggggaagcacctgttcaatctttcacctgtttctttttctttttttttttttttgagacagagtcttactctgttgcccaggctagagtgcagtggcgcgatctcagctcactgcaacctccacctcccaagttcaagtgattctcctgcctcccaagtagttgggattacaggcgtgcacaaccatgctgggctaatttttgtatttttagtagagacagggtttcgccatgttggccaggctggtctcgaactcctgacttcaagtgatccacccgcctcagcctcccaaagtgctgggattacaggcatgagccattgagctcggcctatttcttttttgaattgggttgtttgttttcttattattaagctttgggagttctttatatattctgcatctgaatcctttatcaggtacatgatttgctagtatttttcctagactatgtcatacctttcaaaataataataataaaagcaccttttatgtattaaatagacagacacagctgaagacaaaattcactaactgaaagatgaatcttaggacagtatccagaatatagtacaaagagaccaaaaaagagaatatataaaaaagaaattaagagacaaggagaataaaatgaaagatgaaggtctaataagagttccaaaagaagaaaacagaaagaatgcagaagataaaatacttctcgagataacagagaatgttccagagctgttgacagatgccaatcctcagaatcagtaaattcaacaaagcccaatagggaaattaaaagaaattcacacctggctctgctcacaagggaggattaatcccaatttcattaaatcccaaaactccactaattgacagtaaagggatttttacatcaaataatataaaaccacaaaagcgggactaacagcagtgcacacaacacagatgtttggaagttggcaaaagaacagacgagaaataactgacctagtacatctgagacaaacctcaagccagaaggagtaaaactggataaacactccagttacagcacagaatcttcaaagtttcaggaactgacaacaccatgtacctctggaaaggggaataaaatgtagggactgaaaataaggcagactgagtgaacaatatttaagaggcagttaaatccctatctactccccaactccatgctcctaggtgactgcctctatcctctcctggcataagtctaaaagtttttctctagacagttgaaatgttatctggcctaggagatgataggcacagttgagtcttgggcaccatatggaaaacggtgcctgggtgattacattagcaatgaatgcttctggaaataaacatcacatttatggtcaattgatctgacaaaggtgtcaggcaattcagtgggagagagaatagtcttttcaccaaatggtgctgggataactggatatttacatggaaaagaattaatttgaatcctttaactcacactatacacaaaaattaacttaaaattgatcatagaactacatgtaagagctaaaactataaagctcttagaagaaaacacaggagggtaggatcaattggtcttggcaacttactggatatcctagaataaagcaaaaactgactcagattttaaaactgcttggctgagaagacaggaaaaagttcttccaggacacctaagtcgaatgtgtctttcctctttgctgatctggctctgaatcctttcactgtagcaactcaagagaactctatgcttagtcctgagtggtcctagcaaaccacggaacctggggacatcttggaagcttcaacacaggcatatataatgagaacaaatcaatttgcctttatagcataatgacaaaccagcacagtagtattaacctgacttgctggcctacaattttcagagagcagaacttccccggcttcttagttcagcagctgctgatggacatcaatcacaccaactcagcatcctgcccttctcttccaacccacactcccccctttcttcacagctctccttaatctatccttagatgtctcagcccagaagttagaaggcttattagcatgtcattattctataaccaaggtatacacagaaacattttgggggaagatgtttttcatatcttaaaatgcacgtaaaaccgctctgtagacaataaagtgttttagaaggtaacgtattattaagcttaaaaggtagatgtgtaagccataaaatacagtaacatctttgatgtgatgcttccaatcctaaattattcctctagaggagctctcataccttcctctaattacaagccacataaaggataaaaacacatttttcactttggtttcaggtttcaattttgttgatcttgaaatatacacattatctccttattaacaagaaaaaacttcatcaaggaaaaggtctcatcacatcaaaactggtctacccaatttatcatacatttggaatgctttccttttgagtctcttccatatattatatcatatacaacacacctcacttcttcaacacacggcctactcaatgtatctatttaatcttccctgaagttcaggtcatggtaattctttcttcctttctttctttcacttattattattattatttttttttttttggagacagagtctcgctctgtcacccaggctggagcgcagtggtgcaatctcagctcactgcaacctctgtctcctgggttcaggcgattctcctgcctcagcctccagaacagctgggattacaggcacctgccatcatgcccagctaatttttgtatctttagtagagagagggtttcaccatgttggccagattggtctagaactcctgacctcaggtgatccgcctaccttggcctcccaaagtgctgggattacaggagctagccaccgcgcccgtcccatggtaaatcttagaactcaaaaagatcttcaacattctgttggacaaacaagctataaatgcttgctaaagtgtaacctggatgttcccaagcttggcatggcaacatagtcacatggggagttttctaggccccactccagatttactgaatgaaaatttctaccagtggtgtgtgtgcgtctatttcttaagacgtcctgaagcagatccgcctggaagaactctgtagaggctcttgatttgcagtggacaaatctctactccaatgacagaaggcaggaatgtgaagagggagaatctataatcttaacaacaggaatatttctccctgagtggcagaaggattatgatattgaaaccaaagagaagaaaatataatctagtataccacatggctctgcagtggataatacctgcaaaatctaaaataatgaaactgctaaatggttttcaactttataaccaatctacagacaaagcaaaaaaggtttatagttagataacaatatacaaatattgtcaacctttacaacatgaaagtctggtacagctgcaagagctggaaggaaggaaggaagggaggaagggaaggagggagggagggagggaggaaggaaggaaggaaggaaggaaggaaggaaggaaggaaggaaggaaggaaagatggcaggggcctaatattatcattttacaaagagcaaggtccagagatactgtttaaagttgatagtacaaataaacagagatttaagtatatgaggtagggtcacaaatatagccaataaaagaactagcaattcaataataagttgggaagtagagaggtgaaataacttgctcaaattcagctcattagaaagctccgaggccagtgggctaaacatgggccagtcacactctagattccatgcactttaccagtatctcaccatgcccagccctgtgtgaggaaggaacttgcctaagcttagatgcctagttagtgttacagccagaaaaagaaactcaatcaggctgggcgcgatggctcacgcctgtaatcccagaactttgggaggccaaggtgggcggatcacaaggtcaggagattgagaccatcttggctaacacggtgaaaccccatctctattaaaaatacaaaaaattagccgggcgtggcggtgtgcgcctgtagtcccagctgctggggaggctgaggcaggagaatggcttgaatccgggaggcggagcttgcagtgagcccagatcaggccactgcactccagcctgggcgacagagtgagactctgcctcaaaaaaaaaaaaaagaaactcaatctctagtcttaaaattacttgttacagttatcttcaaattttcagaaaagaccacattaaaaatgtccctatttggttcattctttcaacatacaccaacatttcggctttttttgagatggagtctcactctcttgcccaggctggagtgcagtggcacgatctcggctcattgcaacctctgcctcctgggttcatgtgattctcctgtctcagcctcctgagtagctgggactacaggcgcatgccaccacgaccagctaatttttgtatttttagtagagatagggtttcaccatattggtcagactggtctcgaactcctgacctcaggtgatccaccgaccttggcctcccaaagtgccaggattacaggtgtgagccaccacgcccagccaacaccaacatttcttacaaagagctcctccacagctcccctcacctatgataagcattccatctattctccaagtctataccacaatgatggaggaagacactgcagcccaccatccattgtgtctgtcaaaacctgacagaggatccagaaccaacactgaagatgcaaagcaagtcagcctactcaactcttagtctacaagctaagcccatagcccatctgccgccacagagatgctgtgtttacgtgcacagaggcacccactgcctgctccaggagaggacatggcagcagcatgtgaagggcaggtggagggctgctccaaaggagacatgatctgattcatggaccattatgtgaataggtaacaccactcagtgactgctgctttataatttcatataatattttgaaatattcaatagaaatgacaatatctacccccaaaataattatttaaaaataagttatcacccaaactcattactaccggtaaaaagcaattaaaaaaaaaaaaaaaacagggtcttactctgttgacaaggctgaagtgcagtggtataatcatgactcatggcagcctcaaactcctgggctcaagtcatcatcccgcctcagcctcctgagtagctgggactacaggcagatgctaccacatctgacttttttttttttgagatggaatttcgctcgttgcccaggctggagtgcaatggtgcgatcttggctcactccaacctctgcctcctgggttcaagcgattctcctgcctcagcctcctgagtagctgggattacaggcgcccaccaccacgcccagctaatttttttgtatttttagtagaaacagggtttcaccatattggccagcctggtcttgaactcctgacctcaggggatctgcccgcctcggcctcccaaaatgctgggatttacaggcatgagccaccacgcctggccacatctgacttttttttttttttttttttgacacggagtctctattgcccaagctggagtacagtggtgcgatcttggctcactgcaacctctgcctcccgggttccagcaattctcctgcctcagcctcccgagtagctgggactacaggcgcatgccaccatgcctggctaatttttgtatttttttgtagagacggggtttcaccagattggccaagctggtctcaactcctgacctcgtgatctgtgcgcctcagtctcccaaagtgctaggattacatgtgtgagccacacacctggcctcatctgattaattttttaaaaccttttatagacagagggtctcaccatcttgctccagctgatctcaaactcctgccctcatgtgatcctcccaccttggcctcccaaagtgctgagattacaggtgtaacccactgcacctagccatcaatttttaaaattcaatttaattcactgtcacttaccccattttcagtacgtttttctccaggtacatttattacatttctctgagttcgttgctcttgggtctgacggccacctaaagaaataaaagaaccaaactcaccaaaaggcgtattagaaaaaagtaatattctcccatttcttcatgtattcaaatatttattgaacacaagtgtaaaataccaggctgagaaattcaagactttagtacagttgaaaaaatggtcttacaattaatcttttatatataaagttgttcaggctgcgctcagtggctcacacctataatcccagcactttgggaggccaaagcaggaagatagcttgagcccatgagttctagaccagcctcagcaacatggggagactttgtttccacaataaatattttaaaattagccgggtatggtggtgcaccctgtagtctcagctacttggggggctgaggcgggagaatgacttgagtgagaggggtcgaggctgcagtaagtcaggattgggctactgcacaatcttgctctgttgcactccagcctgggcaacagagcaagaccctgtttaaaaaaaataaattaaaaataaatgaaataaagtgtgtaaatgaaatcttttctttttacattctatctcagaatcttgaaattgacttgttatcaaaaggcttttaacacttaaaaatggagaagatggtaaattttatgtgtattttatctcaattaaaaataaaaatttggggctgggcgaggtggctcatgtctgtattcccagcactttgggaggtgctgggattctcccaaggtgggaggatcacttgagctcaggaattcaagaccagcctgggcaacgtggcgaaaatctgtctctacaaaaaaaaaaaaatacagaaagtagcgaggcatggtgacatgtgcctcatgtgcctgtagtcccagccactcacgaggctgaggagaatagcttgagcctaggaggtagagactgcagtgaaccatgatcgcaccattgcgctccagcccaggtgacagtgagaccctgtctcaaaaataacataaagataaaaatttggcattcatattaccaagagaggaaaaaaaagaaaaaaattttcaaaaaggcatttgcggccaggcatggtggctcacgcctgtaatcccagcactttggaaggctgaggcggacaggctgcttgaagccaggagtttgagaccagcctgcccgaatggcaaaaccctgtctctagtaaaattacaaaaattacccaggcgtggtggtgcacacctgtaatcccagctaactaggaggctgaggcaggagaattgcttgaacccgggaggcggaggttgcagtgagctgagatagcaccactgcacaccagcctgggcgacagagtgagactctgtctcaaaaaaaaccaaaactaaaagcaaaaaaaaaatccaaaaggcatttgcattttagggccaggcatggtggctcatgcctgcaatccctgcagtttcagaggccaaggcaggaggatcacttgagaccaggagttcacgaccagcctgggcaacagcgtgaaaccctatctttaccaaaaatacaaaaaattagctgggcgtggtggcacacgcctgcggtcccagctacttggaaggctgaagtgggaggatcacttgagcccaggaggcagaggttgcagtgagccaagatcatgccactgcactccagcctgggtaacaagtgaaaccctgtctcaaaaaaaaaaaaaaaaaaaaaaaaaaaaagacattcactgagatgggggctggacgtggtggctcatgcctgtaatcccagcactttgggaggccaaggcgggcagatcatgaggtcaggagattgagaccatcctggccaacatggtgaaaccccatctctactaaaaatacaaaaaattagcccggcatggtggtgcacacctgtagtcccagctacttgggaggctgagacaggggaattgcttgaacccgggaggcgaaggttgcagccaagattgcgccactgcactacagcctggcaacagagtgagactctgtctctaaaaaaaaaaaaaagaaaggaaaagaaaaaaagaatattagtaagttgaagggagaagtttagtgagcaaaagcaaaacaaaacatgagacagcacccaataagctactctctatgccacccttttaggcaaaggtaaaggggcagagggtagagtgttacaggtggggaagatggaattctgagtcggggcatgaaagagagagtgaatgtacagctcctgggctcatgcaatcctctcacctcagcctcccaaagtgctgggattacaggcatgagccaccatactcagcccgtttccaaactttataaagtgagaaaaaaataaccactctcctcaggacattaaggattatgtacatattaataagtaaaaggcaagactttttatttaagtatagataagtgagggagggtataggtgtctgaagaactcaggtagagagttaaaataaatccttagcactaaagcagcacttcaactgtcagccagtctaatcctcctcttcaggtggatgttcccagagaggacggaccctggtctaaggtaaaagtagatgaagagttgagcccggagccttggtgtcctggctccagatgtaatggtgtattctaaaagacagccttatgctacggaaagatgattttaaagtagatagtagctcattcaagggcaaattttcctttactataaaatacagataaaggggataacttgcaataaagaagtattatttttacaaaggattgtccttttatttgcttgagttcatttttttaaatattagaagtaatccataatcactgttaattaacaagttaaaggtttttttgttttgttttgtttttgttgttgtttttgaaacacagtctcgctctgtcgcccaggctggagtgtagtggcgcgatctcagctcgctgcaagctctgcctcccgggttcacaccattctcctgcctcagcctcctgagtagctgggactacaggcgcctgccaccacactcggctaattttttggtatttttagtagagacgggatttcatcatgttagccaggatggtctcgatctcctgacctcgtgatccaacctccttggcctcccacagtgctgggattacaggcatgagccaccgcgcccggccaaaggtcttttaactgtacagtgtatacgtgttcaaaaaaatttccttattttctttaaattttaattcaaaaatatatagtatattcccatggttcaaaaatcaaaaagaacaaagaggtatacaatcaacaaccctccctcctctgttctacagccacttttccctttccccccaggccaacaacatccccagttgcgtagatatctttccaaaactgctttatacatatacacatacaaacagatagatatgcacattactctttgctcatctttccacaaaaaaagactaagtgtgcacattcttttgcaccatgcttaattcatgtaacatgtttaggagatggtctgggtcagggcacagaggttcttcattatttacggctgcagagcattctgctgtgtagatggaccctaatttatttagctcagctctcctggtgggcatttaggttgttcctaccagcaatgctcagtgaataaccctgtttatatatcattttgtatgtgccagggcacagctttaggataaattctcagaaatgaaactgctgggtaaaaggttttatgttttgtaagtttaacagccattgccaaatttccttctatagaaggtgccaaccgcctcccacagcaatgcagaagacggcctgtttctcagagtccttgtcaacactgtgctattaactgttttaatctttgccaatgtgacagttaaaatatagtatttcaagatagttttctctgcatgtcttttattaggaataaggtgaatatcttcatatatcctagggccatgtatattccttttctgtgaactgtgtgtgtatatattttttctattattctactaagctttttttttttgagatggagtttcactcttgttgcccaggctagagtgcaatggcgcgatctcgggctcactgtaacctctgcctcccaggttcaagcgattctcctgtctcggccccccgagtagctgggattacagatgcatgccaccaagcctggctaatttttgtatttttagtagagacgggggtttcaccatgttggccaggctggtctcgaactcttgacatcaggtaatccaccccactcggcctcccaaagtgctgggattataggtgggaaccagcacgcctagccaagtttttttcctatcaaattttaggaattctttacatgtaaagagaattagccctttgcaatatgagctacaaatgctacttcccagtttataatttatcttttgactttttttttagatattattgccatgcagttatttttggttttgttttatttatatgtatttcctgagacagagtctcgctctgtcgcccaggctggagtgcagtggcctgatcttggctcactacaacctctgcctcccaggttcaagcaatttttctgcctcagcctcctgagtagctgggattataggcgcacaccaccacatcgggctaatttttagcagagatggggttttaccacgttggccaggctggtcacaaactcctgacctcaagtgatctgcctgccttggcctcccaaagtgctgggattataggcgtgagccaccacacccagcctatttttattttttgagacagggtctctctctgttgccctggctggctggagtgcagtggcacaatcatggctcactgcagccttcacctcctgggctcaatcgatcctcccacctcagcctcccaagtagctgagactacagggcatccaccaacacaaccagctatttagtattttctgtagagatggggttttgccatgcttcccaggatggtctcgaactacttggctcaagtgatctgcctgcctcagcctttcaaagtgctgaaattactagcctgagccactgcacccaggctttgttttaaataattcatttatcagtcttgtcttttatgttttagtgttacacttacaaaggccttgttcacttcaaaaataaaagatcttccagaactttcttctagtattttcatggttttatatatttttaaaatctagatgtttgaccaatctgatatttaccaaaaacaatccctttagtgtggcggtgggtgcctgtaatcccaactactcgggaggctgaaacaggagaatcgcttgcacccaggaggcagaggttgcagtgagctgagattgtgccactgtactccagcctgggtgacagagtgagactccatctcaaaacaaaacaaaacaaaaatccctttaaacaccaagtccctttatatgtctgagtacgttgtttaattaacttagagtcctgagaaggaaagaagcgttggtgcctaaaaagtgtgatgtaattggctgggtacagtggctgacacctataatcccagaactctgggaggctgaggtgggcaaatcacttgaggtcaagagttcgagaccagcctggccaacatggtgaaaccccatctctattaaaaatacaaaaattagccaggtgtggtggtgcacacctgtagtcccagctacttgggaggctaaggcaggagaatcccttgaactccggaggtggaggttgcagtgagccaagattgcaccactgtactccagcctgggcgacagagtgagactctgtctccaaaaaaaaaaaaaaaaaaaaaaaaaaaaaaaagtgccgtaatggtaaacaacactaacagaagccaaagtaacatgggataccaactttccctctagccacttgtaagtgcagggccgggtgtgtgtgaataatttaatatttattcctatttttcttaaattaactttcctagcaaaaattaacaaatgaggaagaaagcagttatctaccttgttcactgttctcagttggggagtcctcgtgtcgaaggaaaaatttcacttcttccctccgtggaccccatttctgaagatgttcgtacatcatatgatcaaagggtatgggacgttctaggaaaaagaccacatcttttttactccagaattaaaatgactccaaccaaaagtaaattttgtaaaaaacttaaatgaatgtatatatgcacacatgtatgtctacatgttacaattcaaagatattacaagcactgaatttcaacattactgagtaaaagcaagaatatgaatgggaaataatttaggcaacagataaacacaaaaagtatccacgaaagcaattttgcaacattaaatagggaacactgaaacatgccttttacaaaacttatttatcacaaagcactgtgtctcccattcatttgtttgtttggttgagatggggttttgctcttgttgccaaggctggagtgcagtggcaccatcttggctcaccgcaacctccgcttctgggttcaagagatgctcctgcctcagcctcccaagtagctgaaatcacaggcatccaccaccgtgcccagctaattttttgtatttagtagagagagggtttcaccatgttagccaggctggtctcaaactcctgaccccaggtgatccacccgccttggcctcctaaagtgctgggattataggcgtgagccatcacactcagcctttttttttttttttttttgagacagagttttgctcttatcacttaggctggagtgccatctcggctcactacaacctctgcctccagggttcgagagattctcctgcctcggcctcctgagtagctgggattacaggtgcccaccaccatgaccagctaatttttgtgtttttaggagagacggggttttaccatgttggctaggctggtcttggcctcttggcctcctggcctcaggtgatccacccgccttggcctcccaaagtgctgggattacaggtgtgagccactatgctcagcctcccattcttgaaagaaacataaattgaccaggccatgttatttcttaaaatgtcaggcgtggcaatcagaggtacgaaggctggacagggcacttcctggcaactcaggcaacattattgtgaatgtttgtcagtaccaagttaataaaaattaaatcctatataactaaatgtatttcaaatatttttttaaaaatcaaagcttactcacaatctctcactcctttactttttttgagacaaggtctttgctctgccacccaggctggagtgcagtggtatgatctcagttcactgcaacctccacctcccgggctcaagcgatcctcccacctcagcctcccaagttagctgaaactataggcatatgccaccatgcctggataatttttgtaatttttgtagagatggggtttttgccatgttgcctgggctagtactgaactgctgggctcaagcaatctgcctgcctcagcctcccaaagtgctgggattacaggtgtaagccactgtacctggccagtatctaaccaattacttgagaagagcactaactcagttgttgaatttaaaggaacacttttatatgtataatgcattccattttccttctctgtgaactgtctcaggtattatgcctatttttcaaaaatctgggttgtggctgagtggggtgactcacgcctgtaattctagcactttgggaggccaaggtgggcagatcacccgaggtcaggagttccagaccagcctggccaacttggtgaaaccctgtctctactaaaaatacaaaaattagccgggcatggtggcaggcacctgtagtcccagctactcaggaggctgaggcagaagaatcacttgaacctaggaggcggaggttgcagtgagccaagatcgcaccattacactgcagcctgagcaataagagagaaaactctgtctcaaaaaaaaaaaaaaaaaaaaaaggctggtcatggtggtgcacgcctgtggtcccagctactcaggaggctgaggtgggaggatcgcttgagccaacacacctggctaatttttgtatttttagtagagatggggtttcaccatgttggtcaggttggtctcgaactcccgacctcaggtgatccacccacctcgacctcccaaagtgctgggattacgggcgtgagccaccatgcctggcctacacccagctaattttttgaattttttgtagagacagggttcaccatgttggccaggctggtcttgaattcctgaactcaagtgatccacctgcctcggctgcccaaagtgctgggattgcaaaactaatcttttacataatcaagatgtttatatcaggttgggcgtggtagttcacgcctgtaatcccaacactttgggaggctaaggcaggtggaccacctgaggttaggagttcaagaccagcctggacaacatggtgaaaccccatctctactaaaaatacaaaaattagccgggcatggtggcgcatgcctgtggttccagctactcaggaagctgaggcagagaactgcttgaacctgggaggtggaggttgtggacagctgagatcgtgctacttcactccatgcactccagcctgggtgacagagtgagactctgtctcaaaaaagaaagttcatatcagctcacgtgctctatcaagaagcactgaaaagctggcatataaaaaaaaaaaaccctagggactgggcgtggtggcttacacctgaatcccagcactttgggaggcaagagtatcatttgagcctaagagttcaagaccagtctggggaaacacagtgagacttaattgctacattttttttttttttttttttgagacagagtctcactgtgtcgcccaggctggagtgcagtggcgcaatctcggctcactgcaagctccacctcccgggttttacgccattctcctgcctcagcctcccgaatagctgggactacaggtgtgcaccacctacgcccggctaattttatttttagtagagatgggatttcactgtgttagccaggatggtctcgatttcctgaccttgtggtccgcccaccatggcctcccaaagtgctgggattacaggcgtgagccgccgcgcccagcctcctttttttttaattagccgggtgtggtggcacacatccatagtcccagcgactagagaggctgaggcaggaggattgcttgagcccaggaggttgaagctgcagtaagccatgactgcacaatgcactccagcctgggtgacagagcaagaccctgtctcaaaaagagaaaaatgaaaaaaaaaaagattaaaaatgctagaatgatctgggggatagattggttaacagatttcagccaattctgtttttagtctcaccattttcaaaagtattaacacctgcaatttcttaaacttccctagcttctttggcatgagtcagacttactgttaccttagattttagctttttgaggtctgctaagtcattaaccacccatccatctgtgttgaacattccaaaatattacaatgctatcacatcctgttcttcaaccttgtagctttaagctattttatcccttttcattgtaattttagtgtaatttcaggaaagaacaaagattgatacggatgcatgtatggtttattcatactacttaagcagaagtccatgatacttttagactataaaatagcatttctcattagccaggcatgacagtgcacatctgtaattgcagctactcaggaagctgagatggaaggatccctttagcccaggagtttgaggctacgactgccattgcgctcaagcctggatgacagagcgagaccctgtctcaaaacaatcaaagcaaaaaaaaaaaaaagtttctcctctgtgagtctacagaaacctagagttccgtaagatgtcactaagggcttcatgagatattgtaactgaaaaaaattagcatttttgaacttcatacagaacatgatattagcatttagagtgacagacaatggccaagcagccctgttagcaatgtcaacagtggtctctcagccctgaatggctgtgtgcaggaccacgttcctttgataaagttcattctcaatcaggagttggtagatggtgagagtattgcagggaggagaggatggtgggctgatggcattagcttctccctccagaaacatcttccccaacacctctttatatgctaatgactgatttatagcaacaaacaagctctagctctgaaataggaatcttggaatttttcattctactgagagaatatttatacctcatgagctgactccctggctctgctattgttaacacttaaaaatacacattgggtaggttaaaagtgaactgtactgtgtatttttgcaattttttttttgggggggatggagtctcactctgtcgcccaggctggagtgcactggcatgatctcggctcactgcaacctccgcctcccgggttcaagcgattctcctgcctcagcctcccgagtagctgggattacaggcatgcgccaccacacccagctatttttgtatttagtagagatggggtttcaccacgttgaccaggctggtctcaaactcctgacctcaagtgatctccccacctcagcctcccaaagtgctgaaattataggtgtgaaccaccgtgtccggccaattttttattttttgagatggagtcttactgtgtcgtgcccaggctagagtacagtggcgccatcttggcttatacaacctctgtctcccgggttcaagcgattctcctgcctcagcctcttgagtagctgggattacaggtgtgcactaccacgcccagctaacttttgtgtttttagtagagacagagtttcaccatgtcggccaggctggtctcaaaccactgacctcaaataatccacccacctcggcctcccaaagtgctgagattacaggtgtgggccactgtgcccagcctgcaattcttgcttagttattaattatgtcttcctgctttatattgtattagtgtttatgtcttaacaaacatgtctgacagtttttgaagatgaggtgtaagataaagaggagaactctagacttatacccacattcaaaagaaatgaaggccgggcccggtggctcacgtccataatcccagcactttgggaggccgaggcaggcatatcacttgaggtcaagagttccagaccagcctggccaacatggtaaaaccctgtctctactaaaaataaaaaaattagctgggcatggtggcgggcgcctataatcccagctacttgggaggctgaggcaggagaattgcttgaatcaggaaggcagaggttgcagtgagccaagatggcaccactacactccagcctgggatacagagtgagaccctgtctcaaaaaaaaaaaaaaagaaatgaaaacatgtccacacaaacttttgtccatgaatgttcacaggagatttattcataagaaccaaaaacgtaaacaatctgctatggtctgaatgtttgtgttcccctaaaattcatatgttgaaactgaatccccaatgtggtaatattaggaggtggggtctttgagaagcgattaggtcatgagagctctatcttcataaatgggtttagtgcccctacaaaagaggcccaagacatggtggcccacggctgtaatcccagcactttgggaggccaaggcaggtggatcgcttgagctcaggagtttgaggtcagcctgggcaacatggcaaaaccccatctttactaaaagtgcagaaaactagcctgggaggtggaggttgcagtgagccaagatggtaccactgcactccagcctgcgtgacagaatgagaccttgtctcaaaagtaaacaggctgagcgtgggtggctcacgcctgtgatcccagcactttgggaagccaaggcaagcggatcacttgaggtcaggagttggagaccagcctggtaaacatggcgaaacctcatctctacaagaaatacacaaaaattagccgggtgtgatggcgtgcctgtaatacagctataaacttgtgtttatacttaagatttataactctaaatcttcagtgcaaccaaagaatttgatgtcaagacaagagataaaactttgtgagctacacaatctaagcacagattcaaggtataagtgattgtaatttactgttccattcctaggtaagttctagatttgcataaagaaaatcctgccattcatagaaatataatgcacattatgctgctgacttttttcttctttttttttttttaagagatggggtctcactctgccacccaggctaaagtgcagtgatatgatcatagctcactgtagccttgaacttccgggctcaagggatcctcctgcctcagcctactgtagctgggactacaggcgcaaacaatcacgcctggctctagctttgtcttatttaacaaacatcaaaggcaaaaacagaaacggtctcatcttagttgaaaatgaaatctgtctgtgcttagctcaagttcatatcagaactaagtatctgtagagcaaaaaacaatgacaagttaaacattaaagaagtaaatttcagccgggagcagtggctcacgcctataatcccagcactttgggaggccaaggcgggcagatcatggggtcaggaattcgagaccagcctggccaacatggtgaaatcccgtctctactaaaaatacaaaacttagccaggcgtggtggcacacgcctataatcccagctactcgggaggctgaggtggagaatagcttgaacccacgaggtggaggttgtagtgagccgagatcctgccagggcactccagcctgggacagagcaagactccatctcaaaacaaacaaacaaacaaaatatatatatagaagtaaatttcattccatatttttagttttgaaagtagcatttttttatatacacatatgcctataaaaagatttttaaaagcaagtgtattggccttttctaactgcaaggcctatatttagctaaatcatgtttctcagttttgcataaaattgtgtcttaggccacatttttattcacattgcttaggcttatcatttagtagctttatttttagttgttttactaatcaacattgtcagtaaattttcatttttttacattaaaatcaacttttaaacttttacatttattaaaatcaatttacaacctatatttaaatataccaagtctgaacataacctaataaaaattaaaacccattttgtcttaagccagttatttaacagaaatttattgtttccctctattcatcgtgtgtgtgtgtgtgtgtgtgtgtgtgtgtgtatatttttttaaagacagggtcgcactctgtcctctgtcacccaggctggagcactgaagtgcagtggtgtgatcaagcgatcgtcccacctcaacctctctagtagctgggactacaggcatgtgccaccacgcccagctaatttttgtattttttgtagagatggggtttggccacattgccaaggttggtctcgaagttctgggctcaagcaatctgccagccttggcctcaagtgctgggattacaggtgtgagctactgcacctggcaaaattttgagaagattaatttcaagaaagcttcgctatatttttttaaggaagtttaactgaacataattttcgttttaaagtagaaaaaacacaacccgatcaacatgacaagaccctgtctctacaaaaaataaataaataaaaggattgtctgggcactgtgcagtttgcctgtgctcccagctacttgtgaggctgagatggaaggatcccttgagcccaggagtttaaggctgcagtgagctatgatcataccacttcactccaacctgggcaactgagcaagactctgtctcaaaaaaaagaaaaagaggctgggtgcagtggctcatgcctgtaatcccagcactttgggaggccgaggcaggtggatcacgaggtcaggagttcgagaccagcctggccaatatggtgaaacctcgtctctactaaaaaatgcaaaaaattagccgggcatggtggcgcatgcctgtagtcccagctactcagggaggctgaggcaggagaatcactggaacctgggaggcagaggttgcagtcaactgagaatgcgccactgcactccagcttgggcgacagggcgagactctgtcatagaaaaggggaagggaaggaaggggaggggagggaaggggagggaaggcaatgggaggggaggggaggggagggaaaggaggggaagggaagagaagggagagaagggaagaaaagggaagagaagtgaggaaaggaaagaaaaggaaagaaaaggaaaaaacactactgatctggttaggttttatgtccccacccaaatctcatcttgaattgtaatccccataatccccacatgtcaagggagagaccagatggaggtcactgaatcatggaggtggtttctcatgatagtgagtgagttctcatgaaaactgatggttttagaaggggctcttcccccttcacttgacatttctccttcctgccaccttgtggaggagctgccttgctttcccttcaccttctgtcatgattgtaagtttcctgaggcctccccagccttgcagaactgtgagtaaattaaacctttttcctttataaatcattccatctctggcagttctttatagcagtatgaaaatggactaactaccctatacatatcatgtaatataaaatatacctaattagcatcttgtataatggaaatctattataagacttttaggaactttaaataaggttaaaaaacctcaagtaggaaacttaacaaaagataaaaatggaaggttttatctaccttactgactgccattagaactgacacctgtgtggggaagggaaccacacagagtagctaatgacctggccaaattaacagactgttacaggctgaactgtgtccccgctaaattcatctgttgtagtcctgacctcaagtacctcgaaatttaactgtatttggagacaggacttttaaagaggcaagaagataaaatgaagagatcaaagtggcccctaatccaatatgactagtgtccttacaagagggggaggtttgtccacagacaggcatggagggaagaaaagaaaaccatctacaagtcaaagagagagagagtcttcagaataaaccaagcctgctgacaccttcatctcagacttctggcctccatcactgtgagaaaataaattactgttgtttaagccacccagtctgtggcactttgttacggcagcctcagcaaaataatgcacagatccacagtgaaacggctctactggaaagcactgataattactattgaaggattctatctacgacatactgatcatactaatgtcagcagttatgggggcagtaatttgttttttgtttttttttttttttgagatgaagtttcactcttgttgcccaggctggagtgcagtggcacaatctcggctcactgcaacctccgcctcccaggttcaagcgattctcctgcctcagcctcccgagtagcagggattacaggtgcccaccaccatgcccagctaattttttgtttttttagtagagacagggtttcaccatgttggccaggctggtctcaaactcctgacctcaggtgatccacccacctcggcctcccaaagtgttgagattacaagagtgagccacagtgcccggccaggtgcagtaagttttatgtgagggttctctgaaacctaaaaaaaaaaaaatctctgtaagggttcctctaggtaaaaggactgagaaaggctgttacagtgcttgccctctccctttgatggcatccactggaagttaccttctcttcttcctagatccagcttcgttggccattttacttactaatctgtgtttactaagtgccttctatgaacactaggctggacactggggatataatggtgaacaacagacaagttcccgccttcaggaattttagtccaacaagatagagataaaaactactactacattatgtttgtttgtttttttttgagacagtctcgctctgtcgcccaggctggagtgcagtggcacactcttggctcactgcaacctccgcctccgggtttcaagggattctcctgcctcccaagaagctgggactataggcgtgtgccaccatgcctggctaatttttgtatttttagtagagatggggttttgacgtgctggccaggctggtctccaactcctggcttcaagtgatccacccgccttggcctcctaaagggctgggattagaggcaagagccaccgtgcccgacctgtatcatgttttgataaatacaacgacagtattagagcacagggacactaacaccctttgagattcacggaagggatgagaggcaaagaataaatagatgttagccaagctcctagggattgttctagacaacgaaggagcatgtacaaaagccacggtaaatgtactgtgctgtgactctgtgctccagggtggtagtcctcatccttgaggaggtaaaactaagttatgatttgagatgggctgggagacaaggatggcaccaaccgagtgactcgtatgagagagacaagcattctcaagaggccatagaccatttagggctataatactcgtgtaaaaattttattcccttacaatgggaaggcagatgaggaattagaattgataacaagtaacagagaacaaaagtgctaagaggctagagaagaaaaaaaacaagggaatgaatgatcaggctctaacactgctccccttaaaaacgttaattacaattacttaactgcctgcttcctgtagctgtcattaggctaacaattgagggcctgtccttttacttctaatttagtaatagtccaatgtttatcaaagtcaagtttctctccatgtatccttaaaattctttactctgaattctaagtaaaaagcacaagaccttgcaaaaaaattgtaatttatatacccacaagggacttgtatctagaatacataaagaacttttacaattcagtaacaaaaagacaaataacccatttttaaaatgggcaatggggtggggtgcagtggttcacacctgtaatcccagcactttgggaggcccaggcaggtggatcacttgagcccaggagtttgagaccaccctgggcaacatggcaaaaccctgtttctacaaaaattagccgggcatggtggtgcatgcctgtagtcccagctacacgagaggctgaggtgggagcactgcttgagcccagaagatagaggttgcagtgagccaggattgtgccactgttctccagcctgggcaacagagaaagacactgtctcaaaaataaataaataaataaataggcaaaggaactgaatagacatttctccagagaagatataaaaatggccaatatacacatgaaaagattttcaccatcattagtcattagggaaatgcaaatcacaatcacaataagacatatcttcacaactactaggatggctaaactcaagcagacagtatcaagtgttgatgagaatgtgcagaaattctccacatcgtatacttcgtatactgctgcagggaatgtaaaatgaagcaattgcattagaaaacagtctggtggttcttgaaaaggttaaacacgaattaccatatgacccagagattcctaggtttatactactaagagatatgaaaatatatgtccacacaaaaacttgtacattgtcaggtgcggtggctcatgcctgtaatccaagcactttgggaggccatggtgggtggattgcctgagctcaggagttcaagaccagcctgggcaacatggtgaaaccccgattctactaaaaatacaaaaaattagccaggcgtggtggtgcgcgcctatagccccagctactgggaggcggaggcacaagaatcgtttgaacccaggaggcggaggttgcagtgaaccaagagcatgccactgcactccagcctgtgggagagaccaagactccatgtcagaaaacaaaaaacaaaaacaaaaacagtttgtacatgaaagttcataggagcattattcataatagccaaaaaaaaaaaaaagagagacagcccaaacatctatcactctggcctgggagacagagtgagatactgtctcaaaaaaaaaaaaaaaagtatacaaaaaagcattttgtaaaactcagtcctgtgcaatataattacatttattttaattactcagttctttattaccacagataactaagaactacaagcaatattttccatttgataaatactaaattatatgtacttagttactttttttccccatctttatcagaaaaaaagcaaatccagcacaagcttagctaaaagatggtgatttgattttatcaatgtaacaatctttacaggacctaatacataccatttcccctccacacttcagctaaatggcagctgccttctccaggttccttgcaaaattctacaacatctcgacaggttgtttccggtgttataggaacttctgttaaaatctgttcattgttgctcaagaaaacagttaatatcatctgtaagacaaaagagtaaagctgtaatttagattccttatcacaaacagattaatctgtaaatttaaagtgatccctctacccaccccccgcccccaaaatgcctacagaattattttctggaaataataatagataagctgattctaaagttcatgtagaaagatgaaaaagacaagtcaggaaaattccaaatgaggagagtaatagaaaagaaagagcactatcttataaagtgctcaaaacaacatgacagcagtagatatatatatagatcaatggggcaaagtcataccccagaaatagacccaattacctatgaaaaaaatggcaaatgatgagggaggtatctcaaaaatcaaggagggaaaacgactatacaatgagtgatgtttgagcaaaatatatccatgtggaaaaaatggtttcataccatatatcgtacactagcagaagttcctaatagatcaaatatttagatacaaaccctaaagccataaaaagtccagaataaaacctgggtatattcccttttatagctttggaataaaggtgctgtttcaaactatgactcaaaaatcagacactatttttaaaaagactgatattcaagtacattaaatataataatctctttttttttttttttttgagatggagtcttgctctgtcgcccaggctggagtgcagtggcgcgatctcggctcactgcaagctctgcctcccgggttcatgccattctcttgcctcagcctccagagtagctgggactacaggcgcccgccaccacgcccggctaattttttatattttttagtagatacggggtttcaccgtgttagccaggatggtctcgatctcccgacctcgtgatccacccgtctcggcctcccaaagtgctgggattacaggtgtgagccaccacacccggccaagaatctcttataatccagaaaaacaaggtaggggaaaacatttgcaactcatattacaaatacaaagctaatcccctcaatacataaagcgctcctaaaaaatgataacagaaagaccaaaaatccaattcctttaaagaaattagccaggaaagtgtattaatatatcacagtaaaagaaaaataaatgacccttaaacataaaaatacattatagtgtatttgaaaaaataaaaatcgtctagccttactttattttatttttttgagacagggtctcactccgtcacccaggctggagtgcagtggcgtgatctcagctcactgcaacttctgcctcctagactccagagatcctcccaagtagctgggactacaggcatgtgccaccacgtccagttaatttttgtattttctgtagagacagggtattgccatgctgcccaggctggtctcaaactcctgagttcaagcaatcctctcgccttggcctcccaaagtgctgggattacaaatgtgagccactacacctggtgtttttttgtttgtttgtttgtttttcttgagacagagtcccactctgtcgcccaggctggaatgcaatgtcgcgatcttggttcactgcaacctctgcctccccagttcaagcaattttcctgccttggccttctgagtagctgggattacaggcgcatatcaccacgcccagctaattttattttattttatttatttatttttttgagatggagtctcgctctgtcacgcaggctggagtgcagtggcgcaatctcggctctctgcaagctctgcctcttgggttcacgccattctcctgcctcagcctcccgagtagctgggactacaggcgcacgtcactacgcccggctaattttttgtattttcagtagagacggggtttcaccgtgttagccaggctggtcttgaactcctgacctcatgatccgcccgccttggcctcccaaaatgctgggattacaggcgtcagccattgcgcccagccttattttgtatttttagtagacacagggtttcgccacattgaccaggctgatctggaactcctgacctcaagtaatccgcctgccttggcctcccaaagtgctgggattataggcgtgagccactgtgccgggttttttgttttttttttttttaatttcaaaaaaatactaacactttgatctagcatcttaagacatcatattggaaggaaatttttttttccccttttcctcagtggaacaatgaaagagatactttaaaaacaatacacctaaagtaaaaattaggctaggcatggtggctcacatctataatcccagatttgggaggccaaggtgggtggatcacctgaggtcaggagttcaagaccagcctggccaacttggtgaaaccccaactctgatacaaaagaaatacaaaaattagccaggcgcggtggcacgcacctgcagtcccagctactcaggaggctgaggcaggaggatcacttgaacccgggaggcatgaggttgcagtgagccaagatcgcaccactgcactccagcctgggtgacagagcaagactctatctcaaaaataaataaataaataaataaaaataaaggaataaagtaaaatttaaaccaaagattttctttaatcagaaggtattataaaacatttatgtctaatctttgacaaaaggtcagaaacaggccagaaatggtggctcatgacagtggtctcagctggaggctgaggtgggaggatcacttgatcccaggaatttgaagctgcagtgcagcttacaatcacgccactgcactctagcctgggcaacagagccagaccttaaaatctctgcattcgagtaagcatatgattttagtttgttgttaagatttttttttcatccaggcacagtggcttacgcctgtaatcccagcactctgggaggccaaggtgggcggactacttgagatcaggagtttgagaccagcctggccaacatggcaaaacactgtctctactaaaaatacaaaaaattagccaggcgtggtggcccgcgcctctagtcccagctactcaggaggctgaggcatgagaatcacttgaaccccggggggcagaggttgcaatgagccaagattgcaccatttcactccagcctgggcaacacagcaagactgtctcaaaaaaacaaaaaaaacaaaaaacaaaaaaaaagatttttttttcttacaagtgccctaaattcctacattctgaaattaagcatctttacatctatggtcagattttatgtaaccaaaattgataacagctttgaactggtttccttgccactaatctcccccgactctaactcctcaccgttaccatttcattttttttcttcttctttttttgagacggagtttcgctcttgttgcccaggttggaatgcaatggcatgaactcggctcactgcaacctccgcctcctgggttcaagcgattctcctgcctcagcctcccgagtagctgggattacaagcatgcaccaacacacccagctaattctgtatttttagtagagatggtgtttctccacattgatcaggctgctctcaaactcccgacctcaggtgatctacccacctcggcctcccaaagtgctgggattacagatgtgagccaacacgtctggcctaccatttcattttctaaaagtcaaataaagttattcccttgcttaaaatatttaagagctccccactgcccaacaccagcccttcccaaaacaccttcgctggtatataagcaggagataggtttcttaactgagcactccttaagagtctaatgtaatgatcatatatatttcttttttccctccagggaatctcatgaggcttggatttctataaaatatactctgagaaaaccttccaggttctaagtctctccaagcactaaacctccctccatcagcatcaatggagttctctctggcagccgtccctctgcccaagtacccttcctgtttgcctgtaaattcctattcacaattcaaaactcagctcctaactaccatttttgcaaaaacatccctttaccgcctccgctcaccagggaggccacatgctccttcctttacgatccagtggctcttcacacagatctctattgcatcacctcaatgactccctccctttatagactctgcactcttccaagcacttcacttttgagtctttaatttcccattgctgagtcaggacctgacgcataggaggcacactaaaatctggtcaactccatgaatgacacacaaatatagaacccccaccatgccctaagttgagaaaaaatatatacacacacaattgaagtaagatatatccagtctgttcaataaacaagcatcatccctcttccctgagcacatttctattttacaataaattttttaaaaattaagtaacagttacctctgctcactaacctgtaagaagaatttataaaaactggggatttttgtatactgaaataagtagcctggaatctacagaatttggaataaaacaggtaatcactggatccagctcaaaccaaggccaagactaatactttaacagtttcatcagaaacaactggaatatagttttattcttacttatacacatttattctacagttgtaatggtaaatattttccaatgtgacttcacaatctatgctcttaaagatctagtaatatcgggaggctgaggcaggacaatggcgtgaacccgggaggcggagcttgcagtgagccaagatagcaccactgcagtcaggcctgggcaaaagagtgagactctgtctcaaaaacaacaacaacaacaaaaagatctaataataaattttcccaaatcatgctttataaattgaagtttcaaatgagtaaaaaaatttttttttactaccttcccttatatgctattcctacagttcactagcaacaagcagaatgccctgtttcactcagtacttcggaatcggtttttcttccttgttccttacccttctacccactaaggcatcccacggtttgctctcaacgctctgagctagcaaaacatttgcacaatcattgcctcatgaatatagcacgcgtaaagcagtacccttaggcactcacagaggcacagcttgtgcttacttgctctgaaacgcggaattctttatgaatgcattgtcagaatgaaggatggtatggcagcattttggggtaccttctgaattaccaagactcttcagctcatgagtaagttcaatatgatgagggagggggagaggcacgatgacaggttgtaaatctggatatttttaaaagcgaagaacacccaaataacttatccaaaagtcactaaacattatttcaatttcttgtgttccattttatcactcgcaataaccctgtctttcctaattttagcaaaattcattttccctaatctctattattcaagctaatttcattataatcatggcagactttaaagctttctagagaaattaagctggttttgacctggatgaccctaaagcatcaccgaaaactgaagctgaaaagccgtgtgactgctaatgttattctagtaagatttcttcagcttaaacatgactaaagaagctccaaaacaaatatagtgtattgattctagatgcacttgcttgtattttaataacatctttgaaatcatagtacacctcacgatggcatgacacaatttaatgggtagcatatttttttctttaatagtatgtacaaaacagatgaaattcagtaggattaaggaaactaaatgaaaaaagaaaacaagttaatacgtttatccttcctaaatgattaatatgttaaaaataaaagatttggggccgggtgcggtggctcacacctgtaatcccagcactttgggaggccaaggcaggcggatcactaggacaggagatcaagaccatcctggctaacacagtgaaaccccatctctattaaaaatacaaaaaattagccggacatggtggtgggcacctgtagtcccagctactcgggaggctgaggcaggagaatgctgtgaacccgggaggtggagcttgcagggagccgagatagcaccactgcactccagcctgggcaacagagcgagactccgtctcaaaaataaataaataaataaataattaattaataaacaaataaataaaagatttggttagctacagttaggaaaacaaaaatttctaattgtgtgctgtaacaaatatagcatgtaatgacaagatgccctacttatgcctttcctcaaactgcttctctgccctgatgaatcacacaacaaatcctgcccctttctgctcactgacagtactctctacccatcctgacctgacctgagaaagactggaaccaatgtctgcccatcttgacccaacctcagataaagcctcctcttctcccctgctgtaacagactgtggctatttatagtacaactttcttacattaaattatcaatagttttcttgactacatcctctactggaacagtatctgtgactcattacctggtcttgaaatcatctaagtgtgtcttaacttgctccattttttttttcattcaaaaaagttggaaaatatcatactagaccataaggacaatacttgtgttctccagctcagtgcctggacacacagtggtgctcaagaaatgcaggatgaggcaggcagaaaactgacaaccattattaagtagcttaagacgtcatcttacccttgctttcaggaacatctgaactaagaaaatcaactgaaatcaaataatcactaatttaagtaaaccacacagatattttaacatttttacaaacttggtatttaaactattttcttggcaatccaaggaaaccaaagcaaaacacaaattgaggatgtataagctattaaaaaacaggaattagctgggcatggtgactcaagcctgtaatctcaacactgagggaggcagaggcaggaggatcgcttaggcccaggaatttgagaccaacgtgggcaacatggtgagaccccatctctactaaaaactaaataaatgaataaacaactagctgggcatcatggtatgtgtctgtagtcccacctactcgggacactgaggtagaggatcacataagcccaggagttcagtgctgcagtgagctatgatcacaccactatactacagcctgggtgatagagtgagatcccatctctaaggaaaaaaaaaaatctaaacaggaattatcctataatcaaagagacagacaatcacaagcattgacaaggatgtggagaaactgaaaccttcatatattggtgatgaagatgtaaaatggtacagctattttgcataacagtccagctggagtgcagtggctcaatctcagctcactgcaacctccgcctcccaggttcaagtgattctcctgcttcagcctcccaagtagctgggattataggcgcacgctatcacgcctggctaatttttttattttcagtagagatggggtttcaccatattggccaggctggtctcgaactcctgagctcacgtgatctgcccacctcggcctctcaaagtgctgggattacaggcgtgagccactatgcccggcctaaaaaattttaaacacagatttgccatatggcccccagcaattccactcctaggtacctaccctggggaaataaaaatatatgtccacgcaaagtcttgtatgcaaatgttcatagctgcactgttcatagtagccaaaaagaagaaacaaggccaggaacggtggctcatgcctgtaatcctagaactttgggaggccaacggtggcagattacttgagctcaagagttcaagaccagcctgggaaacataacaaaaccccgcctctacaaaaaattcaaaaagtagctgggcatggtggcacacgtctatagtcccagctactcaggaagcctaggtgtgaggattgcttgagctcaggaggtcaaagctgcagtgaactgtgatcatgccactgcactccagcttgagtgacagagcgagatgctgtctcaaaaaaaaggaaggaaagaaggaaggaaggaaggaaggagagagaaaaggaaagacaagacaaaaccaaaatctccattaacagataattatggaatatcatacaatggaatattattcagcaataaaagtaacaaagtattgacacatgctacaacatggatgaactttgaaaatactaagctaagtgaaagaggccagacacaaaagaccacatgttatatgattccatttatatgaaatgcccaaaacagtcaaatccatagagaaagaaagatgtgtggttgcctaggactggggatgggaatgaggagtgatggcaaataggcacaaactttgttttggtatgacagtaatgttctaaaattagattgtggtgatggctgtacaactatgtaaatttactaaagatcactgaatgttcacttaaaataggtaaactttacggcacataaattataacacaatgaagctgtttttaaaaagtaggatatataaaacttctagaaaaggaattcagaaacttgacttacatggtacaaagaaccctggaataggaagcccaagttctatccttagctatggcattgactgctgcaactggctggggaagctgctccttagtctatctctgggtcttggtttcttggcaagaactcagcagataatatgaaacacatatttgcaggaaaatggctctcaggcttttctggcccaacccaatcaggtaaagtattagatcccccagctcacctataccatctactacttctttctggtggaaaaggagctcagggataacaaaaaataactgaagagaaataaggtgataaaagctatactaaattttagtaacttgcaataactcacttggtaggttatgagtaaatagctcataaaagccacagaaaggatcagttggggtgagggtgggtgaacaccaggaagacccctttagctttccagcaggccacgcaccccaaaatgagaattgatgctaaggtcccttctggccctgattgcaactcagttcaccaatttaaaatctcagaaacattagagctgtaaggaaaactaagtctaagccatcaccctaaatgcttcatctcactttcctcaattagcctctcaaagactgaaaaacacacctgggagttgctgtcatccacacagaaaaaggagaataaaataaaggattggctcaactcccttctctctcatactccacaaacaatccattagcaagactgtcaacctcgtacccagaaactgataactcgtctccctggctactacccaagcccgagccaccaccacctctcagaaaggatgtctgcaagagcaaactcattcatctgtttccactctcacccttcagatacatcacttcattcaaaaccttcccgtggtttcctctctgagaataaatttcaaagtcctaactattgtctaagaggccctgcaagacctgcaacacacacatgcatacctctctgatctcagtgcttaccacactcttcatcccttctgcctccctcaacagggcaagccaactcctgcctcaggggctttgcacttgctattctctgcatagaccgcttcactcagctactgacattgtattaccctcttctttcaggcctctgctggaatggtgtcttagcaaggaagctttccttaaccgagagtctacctaaaatagcactactccatccctctgtcctcctaccctggtttatgtatttctgcttagcactcaaccaccacctgatctatgtatatatttgtttatcctctgtctgttgtcactagaacacataagcttcttgagagcagagtttcagttaattacctgctgtgtcagtagtgcctgaagcagtgcctggcacgtaagaagcactcaataaactcccccaattatacgtaaaatgtcccttttttttgagacagagtatcacgctgttgcccaggctggactgcagtggcgcgatctcggctcactgcaagctctgccttccgggttcacgccattctcctgcctcagcctcccaagtagctaggacaaaaagtgcctgccaccacgcccggctaattttttgtatttttagaagagacggggtttcaccatgttagccaggatggtctcgatctcctgaccgtgtgatccatccaccttggcctcccaaagtgctgggattataggcgtgaggcaccacacctggccacgaaatgtctttttatagtaggtttcttgaatcatgacaggtaggtgtttgcctgttttctcatcttcaagttctctgtagaaaagacaatattttacccctctaatcactgaattagtccacatcaaagagaagaaaaatattcttaaaaaaagttagtgtaaggctgggcacagtggctcatgcctataatcccagcactttgggagaccaaggtagacagatcatttgaggtcaggagttcgagaccagcctggccaacatggcgaaaccccatctctactaaaaatacaaaaaaaaattagctgggcgtggtggcacctgcctataatcccagctactcagaggctgagacagtggaatcccttgaacccaggaggcagaggttgcagtgagccaagatcacgccactgcacgccagcccgggcgacagtgactctatctcaaaaaaaaaaaaaaaattagtgtgaaagtcaggagccttgaacataactatgtggtattcggcagatttcactcaaacctagagaaacaatggatgtcccttgctctaaagcaggggtgtcccaactttgggcttccctgggccacactggagaattgtcttgggctacacataaaatacactaacactaatgatagccaatgagttagaaaaaaagatcattaaaaaacatatatatatcatgatgttttaagaaagtttactaatttgtgttgggctgcattcaaagctgtcctgggcctcctgtggcccggtgccatgggttggacaagcttgagctaaagcttctttccacaaggtggcactgcagggtaacgggggtgagttcagcactacccccttcccctgacacaaattttagggatgaagaattaactccaaggaaaataaaggtacagtttagtaagatcatattaagttcaatttccataattagggcttgtattattttggaaaaggaataaaattaaccttagagcaatgaaaatttttttctaaataaataagactgtagaagtacatatttaaccctcttacgaaggcagagacagctatacacccattttttttaatgtttcttttttttagagacaggatcttgctctgctgcccaggctgagcgcagcagcaccaatcctagctcactgcaccctcgaactcctaggctcaagtgatcctccctcgcctcaactttcaagtagctgagactgtaaaagcgcaccacagctaattttttttattttttgtagagatggggtctatgcccaggctggtctctaactcctgggctcaattatcctcccgccttggcctcccaaagtgctgggattacaggcatgagccaccatgctcagcctagacatatttaaatatctgagtagcatctactcaaagttaaatagccactacaatagatctcaataaccttatcaattctgttgagttctaatcactgttttacttgcgttaataatttcacattttaaattacattatacagtattcctgggaatacaaaatagacaccttagcttctatttgcattatttacttagtatatagtcccttcagtatttaaaagcataacgcattttgagagaacctatcttaaaccttgtagaaatgtgaaattcatacagctttccataataccaagatgtgtcatgactacaggatatagaggtgatacagctgaccacatttattctatccactaaaacttaaagaatactctagaataggttgggtgtggcggctcacacctgtatgccagcactttgggaggttgaggtgggcaggctgctcgagctcaggagctcgagatcagcctgggcaacatggcgaaaccctatctctacaaaaagcacaaaaaattagccaggcatggtagtatatgccagtagtcccagacacgtggggggctgaggcagggaggatcacttgagcccaggaggtcaaggctgcagtgagctatgatcaaaccactgcactccagcctgggtgacaaagtgaaactcttgtctcaaaattattattattatttttgagacagagtctcgctctgtcgcccaggctggagtgcagtggcacgatctcggctcactgcaacctctgcctcccgggttcaagtgattctcctgcctcagcctccctagtagctgggactagaggcatgcgccaccatgcctggctaatttttgtatttttagtagagacggggtttcaccatgttggccagatggtcttgatctcttgaccttgtgatctgcccgccttggcctcccaaagtgctggaattacaagtgtgagccaccgcgcccagctgtctcaaaattttaaaaaggccaggcgtggaggctcatgcctttaatcccagcactttcggaggctgaggcaggtggatcatgaggtctgaagttcgaaaccagcctggccaacatggtgaaaccccatctctaccaaaaatacaaaaattagcccgacgtggtggcacatgcctataatcccggctactcaggaggctgagacaggagaatcgtttgaacccaggaggcagaggttgcagtgagccaagtgacagagtgagacttcctctcaaaaataataaaaaattaaaattagaaaataatactctagaataaagaacagtatcaattctgacaccactgttcatcaatattgaaaattactttggctgggcgtggtggctcatgcctgtaatcccagcactttgggaggccaaggcaggcggatcatgaggtcaggagattaagaccatcctggctaacacagtgaaactcgtctctactaaaaatacaaaacattagctgggcgtggtggtgggcgcctgtagtcccagctactcgggaggctgaggcaggagtatggcgtgacccgggaggtggcgcttgcagtgagccgagatcgcaccactgcactccagcctggatgacagagcgagactccatctcaaaaaagaaaaaaaaaaattgaaagtgactgcttgaggctaggtgtggtggctcgtgcttgtaatcccagcactttgggaagctgagcccggtggatcacttgaggtcaggagttcaagaccagcctgggcaacatggtgaagccccgtctctactaaaaaaaaaaaaaaaattagccgggcatggcagtgcgtgcctgtaattccacctaactcaggaggctgaagcaggagaattgcttaaacccgggaggcagaggttgcagtaagctgagattatgccacactgcactccagcctagaggacagcgtgagactcctcctcaaaaaaaaaaaaaaaaaaaaaaaaagacaaagaaaattactgcttgaaataatggttgctttactaatgttgatcacgtgaatattatggaagcagaacaaacactgaattttaaaccacagactatgacctcttagtgggctctaaaatcaattagtgcctcaggaccagttttgttttttaatgaactagaacagaacaatatataacagttattaagagaatgaaaagacaagccacagactgggagaaaatatctgcaaagtacatatttgataaaggacttggccaggtgtggtggttcacacctataatcccagcacttcgggatgtctgtaatcccagcattttgggaggctaagatgggtggatcacttgagcccaagagttcgagaacagtctgaacaacatagggagaccccatctctacaaaaaacacaaaaagtagccaggtgtagtagtgcaggcctgtagtcccagcttcttgggaggctgaggtaggaggattgcttgagcccagaaggtcgaggctgcagtgagctatgactgtgccactgcactccagcctgggcacaagagtgagaccgtcactaaataaataaatacataaaggacttgtatcctaaatacacaaataactcttttttcttttttgagatggagtctcgctctgtcacccaggccgggcgcagtggctcacacctgtaatcccagcactttgggaggccaaggctggcagatcatgaggtcaggagatcaagatcatcctggctaacatggtgaaaccccgtctctactaaaaatacaaaaacagcattagccgggtgtggtggtgggcgcctatagtcccagctacttgggaggctgaggtgggagaatggcgtgaacctgggaggcggagcttgcggtgagctgagattgagccactacactccaccctgggcgacagagccagactccccctcaaaaaaaaaaaaaaaaaaaaaacctcaataatcataaaacaagctaatgtttttgtttctgtgtgtggtttttttttttttttttttctagacagtctctgtcacccaggctggaatgcagtggcgcaatctcagctcactgtgacctctgcctcctgggttcaagcgattctcccgcctcagcctcccgagtagctgggactacaggtgcctgcccccacactcagctaatttttgtatatttttagtagagatggggtttcaccatattggccaggctggtctcgaactccttacattgtgatccgcccacctcggcctcccaaagtgctgggattacaggcgtgagccaccgcgtgtggctgtttctgtgtttttgagacacagtttcactctgtcgcccagtctggagtgccgtggcacaagctcagctcactgcaacctctgcctcctgggttcgagcgattctcgtgactcagcttcctgagtagcggggattggggtgcctgccatcaggcccagccaatttttgtatcattagtagagatggtgtttcaccatgttggccaggctggtctcgaactcctgacctcaaatgatccccctgcctcagccaaggtgctaggattacacgcgtgagccaccgcacctggccaaaacaacctaatttttaatgggcaaatgatctgaacagatacttcaccaaagatgacatacaaatggaaaaataaacatatgaaaaacatgttccgtatcataggtcatttgggaattgcaaattattaataaaacaacagtgaaatactactacacacctactagaatggcccaaatccaaagcatcgacaacacctaacactggtgaggatgcggagcaaaaggaacttgcagttgggaatacaaaatggtacagccatgttggaagacagtttggtggcttcttaaaaaactaagcatacttttaccatgtgatccagcaatcccaccacttggtctttacccaaaggagttgaaaatgtgtccagacaaaaacctgcatgtgaatgtttatggcagctttgttcataattgccaaaacttggaagcaaccaagatgtccttcagtagatgaatggataaacaaactgtggtacataatactgctggaatattattcagttattcagcaatgttaaaaaaaaaaagcacaaatccagaagagagtccccactgtactttcacgtccccaccgtactttctgctccatctttctgtatatctaaaacttctataaaaaataagacagtacactgcccatggaaagggtaagatatggtttggctgtgccccacccaaaagctcatcttgaattgtaatacccatgtgtcaaggggagaaccaggtggacataattggatcatggggcggtttctcccattttgttctcgtgataatgcgtgagtctcacgagatctgatggttttataagcatctggaatttcccctgctggcattcgttctctctcctgtcagcctgtgaagaggtgccttccgccatgattgtaagttcctgaggtctcccaggcacgcagaactgtgagtacattaaatctctttcctttataaattacccagtctccggtagttctttatagcagggtaagagaagagtaacatagggtgttttctcctgacattttgacacgtatagatacgtgtctgagtatttaggtaagaactgagtcaccttgtaaaaggtatttcttagtgtgggttcatggtcagaaaagtttgaaagatactactctgagggcctcatgaaacctaccaggacttccataaaactaaatgaaaagtcactgcactagggaaaaaacatttccattatcatttattggtacttattattactcattatagtatggactttacacattctcaattgtcataccatctttgtgatataggtactactcttcactttacagattaggaaaaagagggtcagagaggttaaataatttgtcccagatgggcgtggtggctcacacctgtaatccagcactttgggaggccaaggcggatggatcacctgaggtctggagttcacgaccagcctggccaacatggtgaaaccccgtctctactaaaaatacaaatattagccgggcatggtggcacatgcctataatcccagctacttgggaggctgaggcaggagaatgccatgaacctgggaggccgagcttgcagtgagccgagattgccccactgcactccagcctgggcgacagagcaagactccgtctcaaaataaatgaataaataaataaataaaataataatttgtcccaagtctgctgaactaataaatactagagtcaggatttaaccctggcctgtgtgactccaaagcttaagctttaaaccactactctaaaatgcttcaaaataaaaaagataaggcagtaaaagtttcaatgggctgagccccgtggctcacacttataatcccaagactttaggaggctgaggcaaaaggatcacttgagggtaggagttaagagatgagcctaagcaacttgacgagaccacatcactatttaaaaaaaaacaaaaaccggcggcggggcgcggtggctcacgcctgtaatcccagcactttgggaagccaaggtgggcggatcacgaggtcaggagatcgagaccatcctggctaacacagtgaaaccctgtctctactaataatacaaaaaattagccgggcatggtggtgggcgcctgtagtcccagctactcaagaggctgaggcaggagacaggtgtgaacccgggaggtggagcttgcagtgagccaagatcacaccactgcactgcagcctgggcgacagagcaagactccgtctcacaaaaaaaaacaaaaggaaagaaaaaaaatagatgtttatgtaaaaacttggaaatatttatggtattattcataatagccaaaaagtggaaacaactcaaactgatgaatgcctaaacaaaatgtggtatacccatacactggaatattatttgaccataaaaaggattcaaatgaatgctaaacatggatgaagcttggaaacattaagccaagtgaaagaagccagatacaaaatgttcacatattatatgattctgtttttataaaatgtccaaaacaggcaaatccacggagagataaagtagattagtcgttggtaggagctgggaggaaggagagagcgggagtgactgaaaaatgggtacaagatttctttttgggatgaaaatataaaactagatagtagtgatggttgcacaatttgtgaatatactaagaaccaatgaattgtacattttgaaaaaatgaatgttattgtatgtgaattatgtaccaataaagctgttatttaaaaaacacaaacacaggctaggcatggtggctcacgcctgtaatcccagcaccttgggaagccaaggtgggtggatcatgaggtcaggagttccaagaccagcccagccaacatggtgaaacgctgtctctactaaaaatacaaaaattatcctgcacggtggcgggcgcctgtaatcccagctactcaggaggctgaggcaggagaatcgcttgaaactggaaggtggaggttgcactgagccaagatcgcaccactgcactccagcctgggcaacaagagtgaaactccatctcaaaataaaataaaataaaataattttaaaataataaaaaaaagtacggccaggtgtggtggctcatgcctgtaatcccagcactttgggaggccgaggcgggcagatcacaaggtcaggagatcgagaccatcctggctaacacggtaaaaccccgtctctattaaaaatacgaaaacattagccaggtgtggtgacgggcacctgcagtcccagctactcgggaggctgaggcaggagaatggtatgaacccaggagacagagcttgcagtgagctgagatcgcgccactgcactccagcctgggcagcagagcaagactccatctcaaaacaaacaaacaaaaaactagctatgccaagtattcaacctataccatcagtaaaatatttttctcaatgaaaacaactttttttttttttttgagacaagagtctcactctgttgcccaagctggagtgcagatgatcttggctcactgcaacttctgcctcccaggttcaagcgattctcctgcctcagcctctcaagtagctgggaatacaggtgcgtgccaccacccccggctaatttttgtatttttagtagagacggggtttcaccatgttgaccaggctggtcttgaactccagaactcaggccaggtttccggccaggcacagtggctcacgcctgtaatcccagcactttgggaggccaaggcgggcggatcagctgaggtcgggagttcgaaaccagcctggccaacacggtgaaaccccgtctctgctaaaaatataaaaattagccgggggtggtggcacatgcctgtaatcccagtacttggaggctgaggcaggagaatcgcttgtacccgggaggtggaggttgcaccactgcactctagcctgggcaacaagagcaaaactcagtctcaaaaaaaaaaaaaaaaaattatttcctttcatatatttttccttttctcagcccataaacatttatagctgtaccttaatgtctgcaaataccaaaaattcagtattaatccatttgccagtagcaactggggcttaaaacaacaaagataattagaaaaataatgttcctgaagaacacttttatataatgatgtatatcaatatagcttagtaaatactattcatctgatgaatacaatttacaaaggaaaagtaaatctaatagcaccccatctttttacaaatgactctatccatttcctctttcagatctgagccagctcttgaaaaccatgatgctgccttgaatttgcttataatgctcagagttactgttcttaaaatatttctcatcttcagaaaattaagcaaaagcgaagtgtggaaaacaaaattgcaagtgcctggagattatctatgtcatttacaaagggaaaatacttagatgtccctcaggccttgtggaatctaaattcgggcactaatgacatgagccatgataagatgtcctaatgaaacaagacagaccaccgttgttactgcacagtgacatggtggataaagtttcacctaattaggtgagctccagtgaagaaaaaattcactgatagcattgttcaataacaactgtaaccaagatctagaaatcactatcaaaatgaagactacacataaatttactaatctccatataaaacttgttatattaaaaaaaaaagacttgtctaagcttggttatcaactttaaaaagtgaaacctaaaggtttaaaaatatgttttcacaataaatgccttgttcatgttttatgcttctgaaaactatttgcttgttcaaagtagggtacatacagagctaaatttttttttaattttgttagtattgacattttagataaaatcagaatgaaatttataataagacacaacattaaaggacttttaccatttattaataataaaaatagctaattatttttgcttgctatgtttgaggataagcccctctccttttttttaactctcaacaggcctatgctaggtgctaggatgatgatcctgtcactgcagacagactggcgtgtccaaggccatgtgactgagatgcttcagacatgacaatctaacccaagtgtgtctgactccaaagcttaagtttctactcagatagttcaggaacaaaacagtgctaaagtttatgaacattaaaaaaaaaaacccaactattcaagttcttcatcttgatgaaactacaggaaataatctttacccaaaaattatcagatgggtaaatcaaactttttttttataatgaaagaactcacttcatacatgtaatatacacatacctttgaaaaacaaaacattgtaagtgtgacataaaaggatgaattagtagatattcatcgtaaaatccaaagattaatgtactcacaggctagcctgccaccatgcaaaacatttcctactacagaaaggaaattaaaaatgaaaactttaacgccttccttcccactctatgagttcccactcttttatgaatgtggtttgggtcctgagatttgggtctgctcagataccagaagagcccttataaaacccatctacaatttgtagaatttcaataccatcccttttgaagacactactgattaaaacattaggctgcatatgagttttcatatttctatgaccataatttctactcttgcaaacaacaacctatattatggagaatgactgaatttctcaatgttaatattgtcaggtacctgttttcacacagggagaagaacgaatattttcttggcagctactagacaaatcatacaccagttgatttcgtcctcatggcaacctcagagacatcaactgggatggccttcagatgacaattctttctcctcttctctgggcttcacatttgggcaagttcccaggggtcacgcttattttacatggcccatccctcttgccatgctgactcaactaagaaaaacacttgatgaaaaatgttcttcattatacaaatatttattgagcacctactacctgccaggcactggagatttggcactgacaaaatggacagggttctgcccttatggaattcttactatatagttgggaaaaagagactaaataaataggcaaaaaatatagtatactaggtggtactatatagtatggaaaaaaattaagcagacaaagaagactgggaatggggcaattttagttttcaataagtggttagaaaaagccttactgctgaaggataattctaagttggaaggggaacaaaagcctcactgaaggaggagaaaggatgagccataatgacagcttgaaggaagaccattcaggcgaagggaacaagtgcaaaggccctgaggcagaatgaatgcctgaagagactgagaatcaataaggagtccagcttgactgaagcagggaaatcaaagggagaggagtaggaaatgagagataagctactaattaggctttttctcagaaggatattagcagcccttggagggttttaagtaagaagtggcatattttgccataaaggtttacaggttcactgtggctgctttgttgagaacagactgaggcggggaacaagcacagaattaggaagacctagacatggtggtgcaggcctgtagtcccagctacttgggaggctgaggtggtaggatcccttgagcccaggagtctgaggctgcagtgaactatgatcctgctactgtactccagcctgggcaagagaatgagaaatctgtctattaaaaaaaacaaacaaacaaaaaaaaacaacaacaaaaagaaatgaaacaggaaggagtctcaggaggctaatataaaaatccaggagagaatgagaaccctagaggtaatgcaaaatagaacctgggtacactgtaaagttagctctgacaagatttgctgatggagtggatgtggactgtgagaaagaggtcatgccctagagagaaagcctaccacacctgctgccaaggtccccagagctcccctgtttctgccccatctgaagatctggttgttaggctatccctccagagtccttccaataaacccccttttgagaggttacaaaacaacagttggtttctgccacttgaaaccaaaaggaacttaaccgctacaattattatcattttacaaagagaaacctgagttgtaaaaaaggctcagtacttatcccagacccacagttacttgtagtagagttcagatatgaacaccagtctgactggctcctaagcctgcacttattccattaaagcacactgcttccaaggccttgagtagtcctctacctgccaacgggtacagagagcttaaaacaaaaacaagggggaggggcaggggaaaaaggccagcaacaatcaggcttcagtcccagcaacttccctagggagggacgcgtgagaagcaggaatcatcctattacggacaacgcccctcccttctcaccaccccaccaggtccagagcctcagctcctctgttcagcaaacacaggaaagccccagctccacgaagttgaaagctctggccacagaagaggagagaaaatggggccaaattcgcagatcacctttccttttgttttatcatctttctacactgctgcaaaatcattttctctctcttctcaaaaatagtgttgttattggcttagcactcaggatgttctcacaaggacccgtatttttgacacaaaaataaaacattcaataaacattcacattagtcctttttttttttttaatagacagggtctcactctgttacccaggctggagtgcagtggtgcaattatggttcactgcaccctcaacttcctaggctcaaactatcctcccacctcagcctcacaagtagctgggactggcacacataccaccatgcccaggatttttttttttttttttttttttgtagagacagggtggccgctctatgatgcccaggctggtctccaactcctagtcccaagtgatcctcccacctcagcttcccaaggtgctggtattacaagtgtgagccactgcacccagccctagtcctttcagaagaaaagcttacattagaagctgcaaacttaaaacaacactacataggtgcctcaatttttttctatagtcactaaagttgtttgcggggaaaaaagggataactttttgtttttcttgtaatttgagttagtaagcaagaaagtgattgctacttagtccttttgaaagcattcaattaaaagggttatgttgagatttcaagctatcaaaaagatcagtcataaaatcttagagccagattagaacctaatctatccaacactctttccccattttgtagatgaggaagtagaagcccagaaaaggaaataatttgtcaaggttaataaatcatcttggtaacaaaatgaagactaaaatccaggctgattctcatccctgcatgacacatccttgtcagtattcagttaccttgttcactgaatattaaaggaggtctgtaaaatgtctagcaacagcacgacataccatattctctcaaatctaatttcctcttcctctttttaatttcagtacctgataataatgggcactgaaaaagtcgggaagcctccccgcaacttttaaaatcatagaaatgaactgaaattaagtcacaaaagagacccaaaattgacacaggaacatatcaagtgtgaattataaatacagaggagcactgggcacagtggctcacgcctataatcccagcactttgggaggctgaggtgggcggatcacctgaggttgggagttcgagaccagcctaaccaacatggagtaaccccatctctactaaaaatacaaaattagccgggcgtggtgatgcctgcctgtaatcccagatactcgggaggctaaggcaggagaattgcttgaacccgggaggcagaggttgcggtaagctgagattgcgccattgcactccagcctgggcaacaagagcaaaattccacctcaaaaaaataaataaataaaataaataaataaataaagaggagctgaccacaaaatagatctataatatgatttgaaaacataagagggctccataaataccaacaagaccctggaaaatgtaagctaagtgacaatatttgttaaaaataaataagtccaaggcatttagttgagatataattgagctatcataaaattaagaactaaatatgctgcttttgagtgaaaaaaataagctaacaggacagagtgctaggacaacaggtaaaaccaagaccttcccatgcacatctggatatatggaaacccaatacaaatcatgcctatgaaaaactacattgtttcatccacaagacaatcccaagagatgaggatcaaaaagccacttttttttttttggagacggagttttgctcttgtcgcccaggctggggtgcagtggcacagtctcagctcactgcaacctccgcctcctggattcaagcaattctcctacctcagcctcccaagtagctgggactacaggcacccaccaccacgctaggctaatttttgtatttttagtagacacggggtttcgccgtgttgaccaggctggtgtccaactcctgaactcaggtgatctgcccttcttggcctcccaaagtgctgggattagaagaagcgtgagccactgcacccagccaaaaccacaaacttttataaaatcaagtctaaagagaaaacaccaaaaccccacagaatacatttctttgttcataaaaattcaccctaactacctatttcaccggtggctcacgcctgtaatcccagcactttgggagtccaaggcaggtggatcacaaggtcaggagttcaagaccagcctggccaacatggtgaaaccccatttctactaaaaatacaaaaaattaaccaggtgtggtggcgcacgcctgtaatcccagctactggggaggctgaggcaaaagaatcacttgaacctgggaggcagaggttgcagtgagctgagattgcaccattgcactccagtctgagagacagagcaagactccatctcgagaaaaaaaaaaagtatttcctaatccttcctgcattgaacaggaacaaggaaaagaaccatttatgacatgcaaatgaatgaggtaggtcatatcatccccacgttacagatggagaagcagactcaagagatgcttgacaccttgctggggatcagaatctaaacccagggatgaccccaaaagcctactatatcacattgcccataaggatccctaagtctcttagaacagggacaatttggccgggcacagtggctcacagctgtaatcccagcactttgggaggctgaggcaggcagatcatgaggtcaggagatcgagaccatcctgggtaacacggtgaaaccctgtctctactaaaaatacaaaaaattagctgggcgtggtggcgggtgcctgtaggtcccagctacttgggaggctgaggcaggagaatcgcttgaacccaggaggcggaggttgcagtgagctgagatcgcgccactgcacttcagcctgggtgacacagtgagactctgtctcaaaaaaaagaaaaaaaaaaaacaacagggacaatttggcaggccactgctctccctccatcaaggtgagctggacagtgttattctcaaaggagaaggggagggatggagaagggagaacagtgttcacatacgacttgcacactggacctagctttggtctacattttgcttccttcacacaaggccagccaaaactcatgggctctggaccctaccttgtcaccaagatcttatacctggggaatcaaatgaccttggaaattctaaaccccagaaccaaatttcaaccatcaaaattattcagtctagcagtcttcctcctccttgactgccacctccaacaataacagtaatagcacccacttattgacatttactatatgctggactttgtgctgatcactttccatgtataacaactttcaagcctgccagaaatcctgttttttaaagtatctttcttatttttacaaattaatatacatacactttaaaaaaaaaagtcaaccaatagaggaaataaaaaatagccccctaatgacccacactttaaacagcaggtacatacatatcctttcaaaccctttctacaccacaaaacactttccttcctttttcacaatgaggccacatgaagtagaatgttagttttccagctaacaatatgttttgtcagctgaaaaacattctacctcatcctttttttttttttttttttttttttgagatgcagtcttgctctgtcgccagactggagtgcagtggcgcgatctcggctcattgcgacctccacctcccaggttcaagcaattctcctgcctcagcctcccgagtagctgggactacaggtgcgtgcaaccacgcccagctaatttctgtatttttagtagagacgggatttcaccgtgttagccaggatggtctcaatctcctgaccttgtgatctgcccgcctcggcctcccaaagtgctgggattacaggtgtgagccacagcatccagccctcattctcttttttaaggctatttctctatatgatcacatcataatttatttagagacaggcattattaggcagggtgctgtggctcacacctgtaatcccagcactttgggaggctgaggtgggcggatcacgaggtcaggagttcgagactagcctggccaatatggtgaaatcccatctctactaaaaaagtacaaaaattagctggacgtggtggcgcacacctgtagtcccagctactctggaggctgaggcacgagaatcggttgaactgggaggtagaggttgcagtgagctgagatcacgccactgcactccagcatgggcgacagagcgagactccgcctcaaaaaaaaaaaaaaggagacagcaaatgagtgtctttaagtccacagtgcctatgatcatgtgggtatataataaaagggtaataaatatttgttgtatgtcactttctttgtactacatttatcttccctactgggccatcacatctttcacaatgccctggcatttagtcagagcacaaatatatttgttgaaagtacaggcatatcttgttttattgtgctttgctttattgagttctgcagatattgcattttttttaacaaattgacgggctgtggcaaccctgtgtcaagcacgtctactggtgccattttccaacagcatgtgctcacccatgtgtcacaattctctcaatatttcaaactttttcattattattatatttcctatggtgatctgtgatcagtggtctttaacgttactattgtaattgctttggggcaccacaaatagcacccacgtagaacagcaaacttaactggtaagtgttgtgtgtgttctgactgctccaccaactggccattcccccatttctctccctttctcgagcctccctattccctgagacacattattgaaatcaggccaattaataaccctacagtggcctctaagtgctcaagtgaaaggaaagtgaccatgtctgtcactttaaatcaaaagctagaaatgattaaccttaagaggaaggaatgtcaaaagctgagataggctgaaagctatgtctcttgccaagttgtgaatgcaaaggaaaacttcctaaaataaattaaaagtgctacccagtgaacacacaaatgataaaagcctgaaacagccttagtattgatatggagaaagttttagtagtctggatcaataaaatgagctataacattcccttatgccaaagcctaatccagagcaagggcctctcttcaattctatgaaggctgagaaaggtgaggaagctgcaaaagaaagttggaagctagcagaggttggttcatgagcttcaaggaaagaagtcatctctgtatcataaaagtgcaaggtgaaacaacaagtaatgacagaaaagctgcagcaagttatccagaagatccagctacaatcactgacgaaggtgactacactaaacaacactgtagacagtgattttttcttttcttttttttttttttttgagagagagtctcgctctatcgccaaggctggagtacagtggcgcaatcttggctcactacaacctccacctcccgggttcaagtgattctcatgcctcagcctccagagtagctgaaattacaggtgcccaccaccaggcctggttaatttttgtatttttatttttactattatttttaatttttgtatttttagtagagacaggtttcaccatgttggtcaggcttgtctcaaactcctgacctcaggtgatccacctgccttggcctcccaaagtgttgggattacagctgcgagccaccacactcggccaaacataacctatatgcactgagaaaccaaaaaatttgtgtgactcactttattgcgattatttgctttattaaagtagtctggaaccaaactcgcaatatcttcaaagtaagcctttatagatttaacacccaggatataactacttcccgctcagcccaggccacttgacctttctggatctcaggatgcatacacaattcaaacttgaaacccacctgcttcaccaggagcttccctaacagggctttcacataaagaggtctactcaggtattaccatgagaagtcagcattacaaaggatcttagcagttattagtctggatttctcctcgctttatagtaagagagttcataaattatggttttatgacaaactaataaagcttcaaatcacaagaaatacattgaaaatttcaaaacaaaagtacaaagcagttaagtttagattatggtaggtataggccatgcacagtggggaagacaggaggttgagaccagcctgggcaacacagctagaccctgtctctaccaaaaaaaaaaaaaaaaagccaggtgcagtggctcatgcctgtaatcccagcactttgggaggccaaggcgggcagatcacaaggtcaggagatagagaccatcctggctaacaaggtgaaaccctgtctctactaaaaatacaaaaaaaaaattagctgggcgtggtggcaggcgcctgtagtcccagctactggggaggctgaggcaagagaatggcatgaacccgggaggcagagcttgcagtgagcggagatcatgccactgcactccagcctgggtgacagagcgaaactccatctcaaaaaaaaaaaggcaaaaaaaagtagattaaggctgggcacggtggcacacgccagtaatcccagcactttgggaggccgaggcgggtggatcatgaggtcaggagatcgagaccatcctggttaacacggtgaaaccccatctctattaaaaatacaaaaaattagccaggtgtggtggcaggtgtggtggcacgcacctgtagtcccagctactcaggaggctgaggcaggagaatggtgtgaacccggcaggtggagcttgcagtgagcagagatcgcgccactgcactccaacccaagcgacagagcgagactccaaaaaaaagactgtactagatactttttggggtggagagtggaatgtgaaagcaatgagattttgcaaaaatctagatgtgtagtacagcctccaaaaacattgagaaacccatttcttatctcatggtagtgtaaaattttggtttcagtaattcctagcaccagacttctcctctgaatattagccaatacatcacaaactgctagaaagttatagtatgatatagtatatatcacactatagatctatagtgtgatatctggtgtatgatatatggtatatataatactatagatatatagtattataaagtatatataatactatagatatataaatatagatatgatatactatatcattaaccataaagcttcagcttaagagacttcgataacaattggttgtcacctaacaaaaaaagctaacaaaacactgaggttcatttttccattacatttaatcatggaacttagctactgtgactttattaccaaaagtataagcagctactattgctattataaaaacagcattttcctctcctagttatcccacagaagccttagtatctaactaccagcaactctcaaaaaggacaagaaaccaattggaccataaggtattctctattaagagtgatttttaagagtttgttcaattccagaggcaaataaccaaccacacaaagagactaaaattgggctctaatgtttttgttttatggcaagacatggcagtataaaaagcacggccgggtgcagtggttcatgcctgtaatcccagcactgtaggaggccgaggtgggtggatcacccaaggtcaggagttcgagaccagcctggccaaaatggtgaaaccccaactctactaaaaatacaaaaaaattagccagacatggtggcgggcacctgtaatccgagctacttgagaggcagaggcaggagaatcacttgaacctgggaggcagagactgcagtgagccgagatcacaccactgctctccagcctgggcaacaagagcgaaactctgtctccaaaaaaaaaaaaaaaaaagtgcaagaagccaaaacccatagtgtaaggcagtgttaccttttatgtaacataaattggttacatttacaggatcactcattcattcatttaggaaaattttactcagcccagcttggccctgggccaggctctgagctaacttctgccctcactaaacttggagcagacacagagaaaggacagcagaaaactatggtacagaactgcagaatgccacgagatcccacagaagggctgcctgctccaacaggaaagacttcccaaaggacgccacggaaggttaagacagaaaggagtaagccacagatggaatgagagggtgggcagattatgtcccaagaagacaggacagactggaaacagcagggccggactgctaatcaacggcagatgaaagcaggactgaagaatcccccattaggagctgctttcttctgtgccaaaaacttgacattcaaagaaccatacgaagatttggttgtttccagccatgcgtcttcattctataaggtgataaaggtcctcctcttacctgtcttccaagtactaaatagtaatctttttatatttttattttacttttgctactcttttctactctattaacaaagaagtggagactctcaaaataatccagtgtgttaaatatactgactgcaaaaaaagataaaaccatgaagtctccccagacatagtaggattctaaagtgtttcagagagaaagagtggcttaattgtaacagtattaattaaatgctgataaaaaccatcctctcaaaatttttctaattttaattataaatctaaatcctttatttaatcacactactgctgtgcttgttaatgttgcagcgaacaaggaaactagttacctaaagacatcaattagaaagcatcctcacaaaatgacacttcaacatttttttcttcacctgtgaaaacttgctaaatgcctatgtgaaattaagcaatctctaaagcaagaatgtctttgaactatagtgaatcaaaataatttaatgtttttaaaaaaaatttttttttaatacagacaaggtctttctatgttgttgcccaggctggtctcagactgctgctggcctcaagcaaccctcctgccttggcctcccaaaatgatgggattacaagagtgagccacccatatccagcctgacattttaaagataataaatattttgaggataaaaacacacatctatagtgtatagttactatacacaagggtctcactatgccacctaggctggagttcaatgataccatcacagctcaatgcagcctcaaactcctgggctcaggcatttctgccacctcagcctctaaagtagctggggactacaggtgagcaccaccacacctggctaaatattttactattttttttttaaacgcagtctccctctgtcaccaggctggagtgcagtggcacgatctcagctcactgcaacctccacctcccgggttcaagcgattctcccgagtcagcctcccaagtagctgggactacagatgcacgccaccatgcccagctaatttttgtatttttagtagagacagggtttcaccgtgttggccaggatggtctccatctcctgatgtcatgatccacccaccttggcctcccaaagtgctgggattacaggcatgagccaccacgcctggcctgtatttttatttttattttatttatttatttatttgaaatgaaatctcactcttgtcacccaggctggagcgctgtggtgcaatctcagctcactgcaacctctgcctcccgagttcaactgattctcttgccttagcctcccgagtagctgggattacaggcacacaccaccatgcccggctaatttttatatttttagtacagatgaggtttcaccaagttggccaggctggcctcaaactcctgacctcaggtgacctccccacctcagcctcccaaagtgctaggattacaggagtgagccaccttgcccagcctcttttaggttctttttatgtaacaactcatttaaaactcgtaaaacctaatgaggtaggtactactatgccctccattttatagatgaggaaactgagacgcagagaaattaagtaactcacccaagattacagggctaggaaaagacagtgttgagattcaaacccagatagtctgttccaaaatctgtactctttactgcctcccagtagttttccaaacatacaaaccaagtattcataactgaaaactactataataaaaccccagccatctataatccttaaggaattaattcttatgaatggcagcattctctgaatggctggggatttaacccttccatctcaggcaaaatctgaaattgtgttgtgcatatgatggccactggcacacatggctattgagaacctagggtatggttaagccaaatgagttgtgtcatatacgtaaaatatgttctaaaatttgagagacttagtattaaaaaaaagaatgtaaactaccccactaatgatgttttaatattaactacatactcaagtaattttttttttttttttttgagacgaagtctcactctgtcgcccaggctggagtgcaacggcacgatcttggctcactgcaacctccgcctcccgagttcaagtgattcttctgcctcggcctgccaagtagctgggactacaggcgtgtgccaccacgcccagctgatgttttgtatttttggtagagatggggtttcaccacattagtcaggatggtctcgatcccctgacctcatgatctgcccacctcgacctcccaaaatgctgggattacaggcatgagccactacgcccggcctcaagtaatattttttatataatgagttaaataaaatatattaaaattaatttcaacttcattcttttacttttttttttttttttaggcagagtctcactctgtcacccaggctggagtgcagtggtgcgatctcagctcactgcaatctctgcctcccaggttcaagtgattctcgtatctcagcctccccagtagctggcattacagggcgcctgtcaccacacccggctaatttttgtatttttagtaccgagagggtttccccatgttggccaggctagtctctaactcctgacctcaagtgatccacccgcctcagcctcccaaagtgctgggattataggcgtgagccaccatgctcggcctcttttgcctttttaaagaggctcctagaaaatattaaattgtggccgggcgcagtggctcacgcctataatcccagcactttgggaggccaaggtgggtggatcacttgaggacaggagttcaagaccaacctggccaacatggtgaaaccccgtctctactaaaagtacaaaaattagccaggcatggtgacacatggctgtagtcccagctatttgggaggctgaggcaggagaatcacttgaacctgggaggcggaggttgcagtgagccgagaccatgccactgtactccagcctgggtgacagagcaagaatccatcacaaaaaaaaacaacaccaaaaattagccagggatggtggtgtgcacctgtagtcccagctactcaggaggctgaggcaggaggattgtttgagtccaggagtttaagtccaggactttacagtaagtctgtcactgcattccagcctgggcagcaaagcaagaccctatctcttaaaaaaaaaaaaaaagttatgtttctattgcacacagctcatctaaaatgtatccagttgctgtctacatcattgatattatttactgttttcttgatgactcagtcatcatgaggaactttaactactaccctatgtgtaatctgtcatctgtaattgtgacaattgttgggatgactaaggtcaggctgcccaccttcagacctcaacctcaggttgtgcttgaagctatacctctgtatgatttccagtctgagaccacactctccagccagtctgtctgccaacgactacccctctagtaatctcagatgcagcttctaatgacttagaagcctggtaaattagaactgtgtaacatgtaagaataaaggttatgtgaaggattgaagaagtctacaaactgaattcagtttcaacgccaagttccttgacaactattttgatcactcagagacccttctctgccttgactattgtaagggactactctcttcaactccagacacttaaaggtatcaattttaacttaaattgcagcactttacatctcagcttaagatccatcagctgggcatggtggcccatgcctataatcccagcatcccagcactttgggaggccaagggggggcggggtgcagggggaagaatcaccagaggtcagagttcgagaccagcctggccaacatggcgaaacttcgtctctactaaaaatacaaaaattagctgggtgtggtgatgggcgcctgtaatcccagctacttgggaggatggggcacgagaatcacttgaacctgggaggcagcggctgcagtgagccgagatcgtgccactgcactccagcctaggtgacagagcgagattatgtctccaaaaagaaaaaaaaaaaagatccatcaatagtagtttcagtttgagaagatgcagataaaaacgttctggaggtagatggtgataatggttgctaaacaatgtgaatgtacttaatgccacagaactgtacacttaaaaatggctaaaatggtaactcatattttaacattaaaataatccttcaatattttcatatctttctcaggaacaggttcaaattcttatgtaggtaatacacttccctcacatctggcttctaccacttttccagcctcatccccttcctcttacctcctttggcctcatatcctaggcaacttccctcaacataccatgctgattcagacctcaacattctgcatgtcaatctttctacctggccaggcgtggtggctcatgcctgtaatcctagcactttgggaggccgaggcgagtggatcacctgaggtcaggagtttaagaccagcctggccaacatggtgaaacgctgtttctactaaaatacaaaaattagctgggtgttgttgtgcacacctgtaatgccagctcctggggaagctgaggcatgagaatcacttgaacctgggaggcggaggttacagtgagacaagatcgcactactgcactccagcctgggtgacagagcgagactccatctcaaaaaaataaaaaataaaataaaatccttctacctaaaagtccttccctatcaccttcactccctcttcctcaatcttccaaaccccactcaaatgttgcctcctctgtgaaacttcccaacatcctgaggttgagaagacctctctgccaccgtactctgctgcaccttgtatcctgacttttatcttttggaatggcatgttttagttacatgattgttctcgacaatgtgagctcaccgaaagcaatggctgacccagcatgtaaatgatgaatcctaaaggcatgctgagttccttcagtaagcaagtacatgttaaatgcctaccagagaccaacaatgtcctaagtgccaaggatactgcagtgggaaaagaaaacaaaactctgctttcatggtgcttccacaaataaacaccaggctgatataagtactacaaagaggaactggctgggcgtggtggctcacacctgtaatcccagcactttgggaggccaaggcgtgtggatcacttgaggccagacgttcaagaccagcctgaccaacatggcgaaaccccgtctttactaaaaatacaaaaaactagctgggcatggtggcacacgcctgtggtcccagctgcttgggaggctgaggcacgagaatcacttgaaaccaggaggcagaggttgcagtgagccaagatcatgccagtgcactctagcctcggtgacagagtgagactctgtctcaaaaactagtaagtactacaaagaggaataaagcacaagaaggggagaggcatttcatacaagatggaagatgccatcgaggtagagaccccaagaagggcttttcagctgactgacaggacactgcatgaagtgaaccttattctggttctgagtcaggtctggaaaacagaaagcactgcacagggaaggtaaattttaatgtcttttttttttttttttttttttttttgagaccgagtttcgctcttgttgcccaggctggagggcaatggagcaatctcgactcaccacaacctccgccctccgggtgcaagtgattctcctccctcagcctcctgagtaactgggattacaggtacccaccaccatgcctggctattttttttgtattcttagtggagatgaggtttcaccatgttggtcaggctgatcttgaactcctgacctcaggtaagccacccacctcggactcccaaaatgctgggattacaggcgtgagccaccgcactggctaaactttgatttctaagaaaagcaaactattctctctctgtccatattaacttaatagattttgcaattaaccacctagctactctcagcatgaagggcacaagcattctgcttcagagtaatagggtaattgtgatccttttctgactgaatcttgtttgctaagaagaagcctcatggttgctggagaaaacttaaagtactcagtaaacatttgctcttttttttcttttagacaggatctgtctgtactctgtacagcctgtactctgccaggctggagtacaatggcatgaagacggctcactgcaacctccacctcccaggctcaagcgatcctcctaccttggcctcctgagtagctgggaccactggtgtcagccaccatgtccagctaatttttgtattattttggtagagatggagttttgccatgatggccaagctggtgttaaactcctgggctcaagcaatcctcccacctctgcctcccaaagtgctgggattacaggcatgagccactgcgcccagcacttttttttttttttttttttaaagagaccaggtcttgctctgttgcccagactgaagtacagtggtgtgatcatacctcactgcagcctcaacttctgggttcaagcgatcctagtgccttagcctcctgagttgctgggtctacaaaggcatgccactatgtcctgctaatttttatttttatttatttattttttttttgagacggagtctcgctttgccgcccaggctggagtgcagtggcacgatctcggctcactgcaagctccgcctcctgggttcatgccattctcctgcctcagcctcccaagtagctgggattacaggcgcccgccaccatgcccagctaattttttgtattttttagtagagacggggtttcactgtgttagccaggatggtctcgatctcatgacctcgtgatccgcctgcctcggcctcccaaagtgcgggattacaggcgtgagccactgtgcctggcctttaattttttttaatatagacagggtctcactatgttgccctgtctagtctcaaactcctagcctcaagcaatccttcccccttggcctcctgaagtgctgggattgcagatgtaagccatggcgcctggcctactgacttttttttttttttttaagacacagtctcactttgttgcccaggctggagtgcagaggcacgatcttagctcactgcaatttccgcctcccaggctcaagcaattctcctgcctcaccctcccaaatagctgagattacaggcgcccgccaccacacctggctgatttttatatttttagtagagatggggtttcactatgttggcgaggctggtctcgaattcctgacctcaggtgatccgcctgccttggcctcccaaagtgctgagattacaggcgtgaaccaccatgcccagcccctaactacttattacatatagtaacagacaatgctctaagcacctgacaatcctaacagtatcatgaaatatagtgttattaaacccatttttacaaataggaaaataaggcacaaaggggttaaacaatttgtccaaagttggctggacgctgtggctcatgcctgtaatcccagcactttgggagggagaggcaggcggatcatgaggtcaggagtttgagaccagcctagccaacatggcgaaaccccatctctactaaagataaaaaaaattagctgggcgtggtggcacgcacctgtaatctcagctactcgggaggctgaggcaggagaatcactcaaacctgggaggcggaggttgcagtgagccaagatagcgccatcgcactccagcctgggcaacagagcaagagtctgtctcagaaaagaaaaaaaaaaaaaaaaaattgtccaaagtcacagagttagtaagaggcaaagccagaatatacagtctcgggtctggacttgctgataaccactatgctctacactttcacatctgtatttcccatcacaaatactagctctatcacaaaaatctctgtttatactttggtaatttgtgatgttgactattatttactgatactattttcaagaatgtcattggatagaaatacaaacatgcaactgagtaaaaagcaggacacaagaaatcaacacagacagaaattacacctctacaaaaagtgtacatataaactctgccaggtgcctggagcacaaagatggacaaagtgagtccagtccctgccctgagaaccttggtccagtgggctcagggtgacgctcatcaggcaaaccggaaacacagggaggacgtgtgtgggtgctgcagatgcccaggcagcaatccagaacccactatgctaaagccactgaacataggcaaaaagttttatttaacatatctattttaccttaagatttaaggataacatctttctggacatggcaggcatctatctcaagctccacacagccaaaataaaactccttattctcacaaccctttaaacttactcctttctcaagcagtattttctatcttaaaggaaaggcaagcctggctgctgaagcaataaatctgttatcctcaattccagctatctccctccctccctccttccttcctctctctctctcacacacacttacatgtgcatgcacgcaagcactcactccctcacatgcacacattcacacgcacacatacacacactctccatccgatctatttactgcttttcaactggatctttctcttcttcaggtcctcaagtcaggcctacaacaatttgtttcctaactactcttcctgtttatttttaatctcccttactgcaccaactatctctcttccaataattctggctctagaattatctttctatcatacaaacctgactctatcactccactttttaaaaacatttggtggtttctggctgggcatggcagctcacaactgtaatcccagcactttgggaggccaaggcagacagatcacctgaggtcaggagttcaagaccagcctggacaacatggtgaaaccccatctctaataaaaatacaaaaattagccaggcatggtggcgcacacctgtagtcccagctcctcgggaggctgaggcagaagaatcgcttgaacctaggaggcgaaggttgcagtgagccgagatcacaccactgcactccagcctgggcgacagagtgagactccatctcaaaataaacaaataaataaagtaaataacaacaataaaaacatttggtggtttctgatcatctctacaggatcaagtctaactctgttatggcacacacacacacacacacacacacacagacacacacagctcttcacaatggggtccaacaggaccttccacatcatatctttcttcattcaacaaatatttatttagcaccaactatgtgtcaatcactgggctaaacggcagtggtataatgggaaacaaaaagagagagctcctgctctcatgaagctcacagtctaggacaagaaacagaaatcaaccagtcacacaaacaaatgtttaagattacaactaagacaattactgcaaagaacctccaaataaaataatctgaaattagacagtggcaatagttgtctcgtgcatatactgaaaaccaatgaactgtacacattaaaaggtgaattttatagcacatgaattataccatatccccctccccagaaaaagacacggcagggtgagcacctctgatggtggagttggctaaggcagagacggtgaaaactttccagaggaaataacagagcttacaaataacatatttactgagcatttactacatgccaggcaactttcaccgtactaatgcatctgatcctcctaccaacaatgtaaagttactattatgctcaactcagaggtaagtgaggggtcaagtaactttaaggtcagagagcccacaaatggcaatgccagcatccatatttaagcagaataaagtgagggtctgcactcttacctgctacagtaaagtcacctaggcaatgactattactcagaactacttacgatgcaataaacacagaccactgtgtttcatttctttttctttttttctttgagacagagtcttgctttgtcacccaggctggagagcagtggtgcaatctcggctcaccgcaacctctgctcaccgcaatctctgcctcccaggttcaagcgattctcctgcctcagcctcccaagtagctgtgattacaggcacgtgccaccacacccagctaattttttgtatttttagtagagacgggatttcaccgtgttagccaggatggtcttgatctcctaaccttgtgatctgcccacctcagcctcccaaagtgctgggattacaggcgtgagccacagcacccagcccactgtgtttcatttctgataaaagaaatctctcgccgggcacagtggctcacgcctgttaaccccagcactttggggggttgaggcaggcagatcacctgacgttgggagtttgagaccagcctgaccaacatggagaaaccccatctccactaaaaatacaaaattagccgggcgtggtggtgcatgcctgtaatcccagctactcgagaggctgagtcagaagaaccccttgaacctgggaggtggaggttgtggtgacccaagatcatgccactgcactccaacctgggcaacaagagcaaaactctgcctcaaaaaaaaaaaaaaaatctttctatctcctttgtcattacaatagcctctaaggccctacaagatcaatcctacactactctctccatcacctgacttcacctcctccactttcccccttactcactctgctccagccacacaggcctacttttgtttctccagcatgctgggcatgctcctaccacatggcgtttgcattttcttgagctatgataattacaatcacaacatgtggcataaatcatgattctgctaaaacctcagttaacattttctctaaacacatcaataatgccactaacaagatcttgtactgaactgtacactaatatttcaaatgtcataaattttaataaaaactacctaaattttccagttttatattgttctatatgatatcaccaaagattcttattttacaaaatccagtaacagcagcttttgcttaccaattagtctgaacaacagtcatatagctatctctgcagtgaaataaagcaaagcaatcaagccaagaaagtgtcacaatagaatctgattaccaccattcctctgtttagccctagaaccacagtttgtgaaataactatgacaacagcatttcaaggcaccaaaatcccaccacacttttgctgagaaagtattctccatctgtgcaaacacatacaaacgcatgttgacaaccagttatataacttcaatacaataacccagtgatattttaagttcttattttgctaaaaatcctaagaaactgttaatcctaaaaccgttcagagtaggatgctgagaaaggaatgaagaaaatacatttaacacatttacatttaaaactgagttgtccctaaactccaggtggaaaaaactacctctttttggcagggcgcagtggctcacgcctgtaattccagcactttgggaggccgaggtgggcagatcatttgaggtcaggagtttgagaccagcttggccaacatggtgaaaccctgtctctcctaaaaatacaaaaatattagctgggtgtggaagcacatgcctgtaaacccagctgctttggaggatgaggcaggaaaattgcttgaacctgggaggtggaggttgcagtaagccgagatggcacccctgcaccccagcctgggcaacagaaggagacttcctctcaaaaaaaaaaagaaagaaagaaaagaaaagaacattattgtgtattttgaaacaggagagccactgaaatgttcccaacacatggaaatggtaagtgctagaagcaatggatatcccaaataccctgacttgatcattacacattctatgcatgtaacaaaatatcacatatacctcagaaacatatataaacatattaattaaaaattttttttgccagcagcagtggctcacgcctgtaatcccaacgctttgggaagctgaggcggcatgtcacctgaggtcgggagttcaagacccgcctgaccaacatggagaaaccctgtctctactaaaaatacaaaattagccaggcatggtggtacatgcctgtaatcccagctactcgggaggctgaggcaggagaatcactttaacccaagagatggaggttgcagtgggctgagagggtgccactgcagtccagcctgtacaacaagagcgaaactctgtctcaaaaaaaaaaattttttttaggctgggcgcggtggctcaagcctgtaatcccagcactctgagaggccgaggcgggcagatcacttgaagtcaggagtttgtgaccagcctggccaacgcggtgaaactccatctctactaaaaatacaaaaaaattagccaggcatggtggcgggcgcctgtaatcccagctactcaggacgctgaggtgggagaatcgcttgagccctgtaggcagagatggcagtgagccgagatcacaccactgcactccagcctgggcaacaggtcaacactccaactcaaaaagaaaaaaaaagaaaaaaaaatttttttaaatattgtcctgtctttggtgtttgtttactgaattaggctgtaaaatcaagcttatcaagtcacctaattcttaattaaaaaatagtagcaaacatttactgagctcttactatctgctctgtcataaaagatgcttcggaaatgaaagagtttactagaagcctgccaaaacaagtgtcaagttgcctcaacctttgatgaagcgaatatgaatattagagaacttcatgcaagtatctgctataaatcagctactggaccaaccataaatgcctgaaaattaccacatccacctcattttacagatgagaaactgaggcccgaagagactaagtccaaaggtcctcactaacaagtaggagcaagaaccctatttccagttcagggttttgttgtcaattacgtgttatttgtttatttaaaaaagagaaaaacctattctagtatctcaaaatgcttctacatagttgggaagaaaatgaatacctagaataagtaaatatttaatgaaagctaaatactgaaaacaaattaatgtcatccctaccctgcagtaaacatgctgaaagggctcctaggacagaaataagtagaatcatagccacacttcacagcatctagtagaagttaggtgccccattgctaacatcaccaaacaccaccaccagagtgccttctttttttttttttttttttgagatggagtcttgcattgtcacccaggctggagtgcagtggcactgtctcggctcactgcaacctccgcctcccaggttcaagcgtttcttctgcctcagtctcctgagtagctgggactacaggcaccctccatcacacctggctaatttttgtatttttagtagagatggggttttaccatgttgagcaggctggtcttgaactcctgacctcaggtgatctgcccatctcagcttcccaaagtgctgggattacaggcgtgagccaccataccaagcccagagtaccttctttatgaagagaaaacacttcagagctacagaacagttcttgactcgtcgatactcttttggaaaagaaaaagtatgctggccgggctcggtggctcacacctgtaatcccaccactttgggaggctgaggcaggtggatcacctgaggtcaggagttcaagaccagcctggccaaacatggggaaattccacctctactaaacatgctaaaattagccaggcatggtggcatgcccctgtaatcccagctccttgggaggctatggtgggagaattgcttgaacccgggaggcggaggttgcagtgagccaagatcgcgccactgcactccagcctgggcaacagagtgagatcttgtctgaaaacaaacaaaaaaagtatcttaagcaacattccccacatatatctcatctatgcacgaaaagttttactagctacaaaacgtccacactctttcaaaaagaaacgatgctgagctaggtgcggtggctcacgcctgtaatcccagcactttgggaagttgaggtgggcagataactggaggccaggagttcgagaccagcctggccaacatggtgaaaccctgtctctaccaaaaatttgaaaaaattagccaggcatggtggtgtgcacatgtagtcccagctactgtggaggctggggcacgagaatcacttgaatccaggaggcagaggttgcagtgagctgagatcctgccactgcactctagcctgggtgacagagcgagactctgtctcaaaaaaaaaaataaatcatgctgaatcaaggcagttttcatcctttctataatctaaattgggctttccatttttactaaaattcttacttctatcaaacttgtaaatgctttcagggccagatcttagggactaaacaaaaagtattatttaaatggtaccattttttcctgggaaaacatttttaaaatgtcatccattgataaaaaggtgagtgactaccaataacaacaacaaaaaaatactattttcataagggaaaattccaaaatataatttagtttagaagtggaaaggacggcagagcgcagtggcatacgcctgttatcccagcacgttgggaggctgaggcaggcagatcacaaggtcaagagatcaagacaatcctggccaacgtggtgaaaccccatctctactaaaaatacaaaaattagctgggcgtggcggcgcacgcctgtagtctgagctacttggtaggctgaggcagaagaatcacttgaacccaggaggcagaggttgcagtgagccgaggtcatgccactgcactccagcgtggcgacagagcaagactccgtctcaaaaaaaaaaaaaaagtggaaaggccaggtgcaggggcagaggggtggctcacacctgtaatcccagcactttgggaggctggggcgggcagatcactcaagctcagaaattcgagaccagcttgagcaacaaggtgaaaccccgtctctactaaaaatacaaaaattagccgtttgccgtggcgtgtgtctgtggtcccagctactcgggaggctgtggcatgagaatcacttgagcctaggaggcggaggtcgccgtaagctgagatcgtatcattgcactccagccttggcaacaggagtgaaaccctgtctcgaaaaataaaaaaaaaaagaaggtggaaagtcacagcactttgtacgacagcaaatagaagacttctacagagatttgattgtgtcagatgagaatttggccactcactctcatttattctcaacagctgagagactgggcactgtagtacaccatgtgattaattaaaagttaccacatggccgggcgcagtggctcatgcctgtaatcccagcactttaggaggccaaggtgggcagatcacctgaggtcatgagttcaaggtcagcctgcccaacatagtgaaaccctgtttctacaaaaatacaaaaattagccaggcaggatggagggtgcctgtaatcccagctactcaggaggctggggcaggagaatctctcgaacctgggaggtggaggttgcggtgagtcaagatcatgttgcactccagcctgggcaacagagtgagactctgtcacaaaaaaagaaaaaaagaaaaaagttaccacgacattatatactaattgccaattttcaaataaaataaaatatactctaagcctatgttgtccaatatggtagtcactaagcacatgtagctactgagcactggaaatgtgctagtctgagctgaggtgtgtgctgtaaaatgcaaactgtcaccggattcacaccagatttcagacacttagtaccagaaaaaatgtataatatctcattagtggttttttcatattgaatacgtgttaaaataatattttggatatgctaagttaataaaaggatactactaaaattagtactttttcaacttgtttcatgtagttaccacaaaatttaaaattgcatttgtggcttgctttacatttttattggacagtactgctctacacaaactgcaaaatatgacccaacgttcctttgattcatcatcatcatgatgaataccaaatatacaataaatcgagaaaaatcttatttacatttttggatagtttaaaatattaccaagtaagaatggcatttctgaaaactcctactaaatttacaaccaactccaactgtgttaatagaggaaggactcagtcctacaagtagtatttttagggatcaaaaaggaaatacaaaagtaaaagccatacatgagagtctaagagaaataccatctgtttctaaaaggcatttttaaacaaaagcggtgttttaaacaggtaatagacctgtttttttaaaaaacagtattttattgttttgagaaatccgaagaaatgccccaattcccagctaaacaaacctcttaaaaaggaaacctgtgaaggtaggaactcaaaactctactcccgtggaatagaggtaagatgtctgaatgaatcatatggaaaatgtaagccaagtttcttagcaggatatttataattaaacattatacaacgacgaagccagccaaaatttttctagatatccttcaatgccaccacagtatgaatgcatcaatcaactattacaggatttaactaaaactactttcaaaattctgaaacaccataatgcctttcatcaaaatctagctagtgagaattagggagggaagtttccaaatgccttatcttataaagttagaaattgaaaattcaaagccatattaagaataataaatatttgtatgacattctgttcaaccatcacttttggatacatcatcctatttgatcctcaggacagcgctcagatattggtacatttttatccctactttagaggtaattccaggctcaaagaccttgacttcttcaaggtcacatagctaaaaagtggaagaaccagcgtttcaccccagatcttctgatgctcatccaattctctttccattacaagacaattattcatttaaaaccaaatgtttagaaacccaacaagtctgatgctaaagaaagacctaaggatcaagtagatcaaaccttaagacttggaaaacgctgaaagccggctacaaaacatgctggaatccgttaaaaacggggagaagagattatcaagagaaaggaaatcaaagaggaagaagggggatctaatctaaatgtccttgggtgcagcatagcagaatggcaatattcaagtagagaatgcagggaaactgcactttcctgtgaaatgtgattttcaacgtagtattgtaggttaaaaaaatgactgtgttactttactataaacgtgtttgagaattttacttacgatataggcgctcagaaaaccaatacctctccaactgggtacaaccagtcccacattttttcataagtcatgatgcttacctcccaaaaagccaatttttaaaaatcagaattcagcatcccctcctattcagattataggtaaagggaagggtcggtaggacgatggcaaatctaatggccaatgtctttctaggcgaaagcatccttaagggcaggacaaagacaccaccactacaaacgaacctcgttcaaccttcagaacacggagaacaaaccagttaaagcaaaacgaaccaacattgcagatacgggaaaagggaattcctaagatggctctccaaatccgtgcactcggcacctttcctcagtacaaccgcgaaggctacgggaatgcgcctgcagagtgtgggaactccgggcgcgggtgcccaccccgccgactcccagggcgaccccagaacgttcgtttcaggcgggtcacagctgcgccacccaccagacctgtgccccagcgtccgaccgcgcacctgagaggaccgaggagatgaccggccccaaatgcatctgcttctccccgcggccgcggaggccgagcaggaagggcccgcaggcggccccggccccgcgctgacagcccggcgccgcccccacctgcccgcctggggggcgccgcggccgggcgcgcccgcccagccacttccttccccgcccgcccggcctcgcaccggcccgcgggggctgggagccgcgggaggaaggaggtttggccagcggcccgcggaggaagccgccgccacctcccgcccgccctcacccaccggcatcatcgcggggagagtccgcgacgccctcggccgccgcctgacaggacgctccgcgccgagctgtgcccaccgctccggccgcctcctaaggccgcgctcccgccgccgtgctctccggcccggccgcggcgaggcggcagctgcggcgggctgcggggctctcgctggccctgtcgcggccgccggcgcgctgcgtcgctgtcccgggcacccggccgccgccgccgccgcctcaacctcagcctcagcctcagccccagcccgacagcctgcggcccgcccgcccggctcgctcttcagcccccgcaggccccgcccccagcgcgacgccccgcacgggtcccgtagccccctctgattggcccggtgggagcgggggcggggagaggggcggggcttcccggctccgcccgctaccctcgctctcagcggcggccaggtgcgtgcgcgtccgcgctcccggcggcgggggaggggcggacgcgcagtgggcaccggtggcctcccccgcccttgcgtgagccccgactagggaagaccgcggacggtgggaggactgaggcccgacagggaagggccggcccgggtcccgcagcggatcacggcagggccgggactcgaacccgggctcccgggggccgactgtgggccgggagcgtccctgcggcgacggcgcgcgcccgcactctgaccgcggcctgacccccggctgccggcgcgccgtggggctgcggcccagaggccagtgggaggggcgcggggggcccccggagcgagcatgtgacccgaggccgcgcgctcggaaccagccccggcccgacgcccttggctggcacctgcttctcccccaccggcgtcttccgcggctctcggggccgcgccccccgcaccagctcccgagccttggccttcgcccgagcgatctcccgcctagaaccccgcgcccacctgtgccacctgtgcccacctgcgccagcatccctcgaggtccagctccagcgtccccggggagggtccggtcctcgtctccagggcctgggtctctccctgcagtcccgtctccagaggcgccgccccctcgggcctgagcgccggagtgacagagccctgggcagggccctgagcagaccctcagtaaaggctgccaggggggtaggcacccgctcggggccccccacatggtgccattcgcccggaccgcggcggagagcagacagggggactgaggtgctccccgcggcagcaccgaactcccacgggcatcagaaggcaaggtctgcggatggccccagacacagaaggcgtaagccgccctgggaagcgccggcccagtggagaaggccgccgcgaggtcagggtcagtctggagcctgtctggttctcggagaggcttctggctgctgcagagtgggggcagagcaagggaggaggccagggagctcccaccagcccattcctggggagccacccctgtccctcagaggccacgggggctcgtgtttgcgagtgtggactttccagttagacagacttggttcagcaccgcctccgccacaccctcgcctgggatcctaaacaagccgcatcttctctgcatcgtagtgtgcttgtctctgtgatgggagagtgtagggataatagtgcctgcctcgtgtcaagaggctttttcggatgcgagggatggaaagcgcccagcacaatttgtggcacgtggtagctgttccataaatagcattctgtagttgggccgtgattagcaaggaggcttagtgtacagacgtccctgggatttttaaacctatccacacctgggcatgaatggctaatgacacccctcttctgggagcagagtttggagagaagaggaggctctagataatgagtgatcctaggctgaaagtcagagacatacttaagttctaattctagctgctctgcttctgacctcctgtggggccttaggcaacttgcactccttctctgggccttggtttccccagctttgacagctgatgtccctgagtcacgaaggggtacttctggcccacgaagcctgacaaaggacaggttttgccaaggctcttcagagaggtgccccccggggtaaggtgatccaaatgagcctgctcttccaggaagggaagcattggcacaagggctcccctcttgcctgcaggacctgtgggcacagacagtggcagctaccgtgcctcacaccaaagcatcctatatcctccaggtaagggtccatttgaggcaggctggtcagctccccctcaagtccttcccgctggtccccatcctcctctccacccagcctgccacctccaggcatcggcccatcacctcccacctggaccaagctcattcattataagcccactgctctagcctccacgcccccaccattcccaacacgcccctgccctccatcttcctggagcacacacggcccaaccctgtaaagcccttctgtgtctctccattacacagaccaaagttcacgagcagcccatcaggaatcgccgtgaatgttgttaatgtgcagtggctcacgcctgtaattctaccactttggggggccaagatgggaggattgcttgaggccaggccaggagttcgagaccggcctggtcaacacaatgagatccccccatctctaaaaaaaaaaaaaaaaaaaaaggaatcaccagtaatgatgggatataggcattaaggttacggaagaagatgtccatattttttagagatgcatcctagcatatgtaaggggtctgcaatttgtttaaaaacaattcagccagagggaaagagagccaagcaattaggaataactgaaacatacgtggcaaattcttgataacatttgaacctggatggtgggtatgttggggtgcattgtactttatactctatgtttgaaatattttatgttaaaaatgattaaaggggccgggcgcggtggctcacacctgtactcccagcactttgggaggccgaggcgggtggatcacgaggtcaagagatcaagaccatcctggccaacatggtgaaaccctgtctctactaaaaatacaaaaattaaccggccgtggtggcgagtgcctgtagtcccaactacttgggaggctgaggcaggagaatcacttgaacccggcaggcagagattgcagtgagccgagattgtgccactgcactccagcccggcaacagagtgagactccgtctcaaaaaaaaaaaaatgattaaaggggctgggcacggtggctctgcttgaaatcccagcactttgggaggccaaggtgggtggatcacttgaggtcaagagttcaagaccaaccttgccaacacggtgaaaccccgtctctactaaaatacaaaattaactaggcgtggtggcatacgcctgtaatcccagctactcgggaggctgaggctggagaatcacttaacccaggaggcagaggttgcagtgagccgagattgcggcactgcactccagcctgggagacagagcaagactccatctcaaaataaataaataaataaataaataaataaaagcaaggcatggtggtgctcacttgtagtcccggctcctcaggaggctgaggcaacaggttcacttgagcccgggagatggaagctgcagtgagccaagatcacgccactgcactctagcctgggcaacatagaccctgcctcaggaaaaaaaaaaataaagattaaaggctgtagattaaaggctgggcatggctgggcatggtggcttaagcctgtgatcccagcacttgggaggccaaggcgggcggatcacctgaggtaaggagtttgagatcagcctagccaacatgctgaaaccctgtctgtaccgaaaatacaaaaattaggccaggtgcagtggctcacgcctgtaatcccagcactttgggaggctgaggcaggcagattgcttgaggtcaggagttcgagaccagcctgaccaaccagtctctagtaaaatacaaagttagccaggcgtggtggcacacgcctataatcccagctactcgggaggctgaggcaggagaattgcttgaacccgggaggcagaggttgcagtgagctgagatcgcgccactgcactccagtctgggcaacggagtaagactctgtatcaaaaaaaaaaaaaagttatctgagcatgatggtgggcgcctctaattccagcttatcgggacgctgaggcaggagaatctcttgaaccctggaggcggaggttgcagtagttgagtttgccccactgcaccccagccttggtgacagcaagactctgtctcaaaataaaaaaataaaaggctgagcatggtggctcatgcctgtaatcccagcattttgggaggccaagacaggaggattgcttgagcccaggagttcgagaccaacctgggcaacatagcaagacccccccccatctctattttaatttaaaaaaattaaaaatgattaaatactcttaaaacagataaaaagtccctttagggaggacattagtatatattcatattggcataaatacattctggaagaatccagggaacactaataaagtgatgactgcacgtgggaatgggaactgggttgataaggggcagaaatcagagtgaggcttttcactattagtttttgaaaaataaactttatttttagaacagttttatagaaaaattgcaaagagtttgaaatacagagagttcccagatacccctttctccatccagttttccccattttttaacatcttacatcagtacagtacatctgttacaacaaatgaaccattatctatacgttagtatcaactcgggtccatacttttcccagatttccttagtttttagccagtgcctttgtttcaggacatcacgtggcgttcagtcgtcatgtctccttgtctccttagactcctcttggctgtgacagtctcggctttccttgttttttttttttgttgttgttgttttgtttttttgtttttttttttttgagacagaattttgttctcactgcccagactggagtgcaatggcgcgatctcggctcaccgcaacctctgcctcccgggttcaagtgattctcctgcctcagcctcccgagtagctgggactacaggcacccgccgccacgcctggctaacttttgcatttttagtagagacggggtttctccatgttggtcaggttggtctcgaacttccgacctcaggtcatccgcctgcctcagcctcccagtgtgctgggattacaggtgtgagccaccgctcctcgccagctttccttgttttttatggctttgacagttttgagtgcttgtcaggtattttgtagactgtccctcagttgaaatgtatgtgatgtttttctaatgattacactgatgttatgagtttgggggaggaagaccacagaggtacgggaccattctcatccgattgtatcaaggatacatatgatcagcatgacagtgccattgacgctgaccttcatctctaggctgctgttgcatttcatgtttgatttttgaatcaggtgactatattactaaattacaataacatgttttaaaacttgactgggcatggtgcctcatgcctataatcctagcactttcagaggctgggatgggtgccttgcttgagctcaggagttggagaccagcctgggcaacacggcaaaatcccatttctaccaaaaatacaaaaatcagccaggtgtggtggcatgtgcctgtggttccagctacttgggaggctgaggtgggaggattgcttgagcccaaaagtttgagaccagcctgggcaacatggtgagaccccatctctacaaaaaaattttgtgttttttgtttttagtttttttgttttttcagacggagtttcactcttgtcacccaggctggagtgctgtggcacgatcttggctcactgcaacctccacctcttgggctcaagcgactcttctgcctcagcctcctgagtagctgggattataggcatgagccaccacgcccagctaatttttgtatttttagtagagacggggtttcaccatgttggccaggctggtcttgaactcctgacctcaggtgatccacccacctcagcctcccaaagtgctgggattacaggcatgagccaccgccgcctggcctctacaaaaattttaaaaattagctgggcatagtggcaggcggcttcggtcccatcttctcaggaggctgaggtggaaggatctgcttgagcccgggggtcaaggctgcagtgaaccgagataacaccagtgtactcccacctgggtaacagagtgagaccctgtctcaaaaacaaaataaaacaacagcaacaaaaaaaaacatgcctaagacccgtattggtttgctaggcctaccataacaaaataccacagactgggtggcttaaaaaaacagaaatttattttctcacagtttcgtggtagttttctggaagtccaagctccaggtgctgcagggctggactcttccaagacctcttgccttggctggcagatgaccaccctcttgtgggctcctaacatgatcttttgctgtgtgtgcacctgcctggtgtctctcttttcataggtcatagtcacattgcattagggcccagccataggacttcattttacctaattacctgtctgaagaccctacctccaggcccttgtccacccacctccctgtgtacgagaaagcactctgtgtatccctcagaaaggagtgcttcctgttctgttgaaaatcaaagccttcttctgcagcatttccccagatcgcccagggatgacgcatctcaccacattcctccagactgcccagacctgggtcacgcatcacaatctgccaccttggagctgtctatgtacctgttgccccaggggccagcaggctccatgaacaggtgtcgcctggtttcttccatgtacccacccaggtccaggccctggtgacacagccttgagcaaaacagtgaggtccctgtcctcacagagtttgtattccggccaggcaagaagacgatagacaagaacacaaatgctggtaagtgtatttttaacaataagtccaggccgggcgcggtggctcacatctgtaatcccagcactttgggaggctggagtgggaggatcacttgaggacaggagttaaagaccagcctgggaaacataaggagagcctgtctctacagcaaaaatacaaaaagtagtcagacgtggtggagtgctcctgtagtcccagttactttgggaggctgaggtggaaggatcgcttgagcccaggagtctgaggctgcagtgagctgagatcgcaccactacactccagcctgggcaaaagagggagaccctgcctcaaaatagtaataacaacaataataataaagccagataatgtgacagagacagctgcctctgccagggagttgcaggctgcaggagcagggagggggaggagcaggtaaggaaagtgctggaggctatggagggaggtagggtcaggcttcagtttgcgggctgtggcgggtctggattttgttggccctgagggcagagggccttccctctggtgtttccaggggaaactctttctgacagctgatttacagtcttaagcttccggtggaagttggctggccttccgcagcagtggaggaggacgggcccttaggatgaggaaggtagaggaagtggatgtggggaagggcttctatctggggtaagatttgaagggtgggagttgggaggaggaaaggaaggactcaggatggctccaggctttggggctgctgtgcagggcctgcaacctggcacccacagtgccttatccaggcctaagagagggcgctgtgggctctgtgctgacatctgcttggccacgctgtccccaagaaggccacatttcatgactccccttcctgtccagcctgggcctgtggcccactctgggatccatctggcactgcagccaaatgccaggtgttaccgtgcccctcaccccctcagtccttcccccacaacacacacacctccttttttctctggccccaccccaacctgagctgccctcacctctactccaagttagcctccctcccgctggaaaatccgacccaaccactccccactgggacccctcggggcctcccttctgccctgacggtcaagggtagttaaacccctgagggcttgggtttgcggctctccagcctcatgccctcaccatcccccgctccaggccgactcccaccccaccctaggccccgctggcagcccctccccagtgtgggggtggggactctgggacaatgggacgtgcagctcctgttccacccccacagctgcccggggaaacctgttttcacaagtgttggctgtgaaccagtcgtggttccatttgctcctctggggcattaagtaatattttttgttatccaggttagaaaataagttggtgggaaaacacccagcgatctgcttgtttttggtcttttgtttggccgtgggtggcccctgtggcctgtgaggctgcacttgtgtcccccaccagatccccagtgcccagcacacagtagacacctaataaatgtgcatggagggcagactccaccgctgcctccaccaaataaaatacagctggaaacccagcgacatccaccccaggccacagaaaagagtgtccctgccaggagttcccacacaggagtcttggaactcagagagggggtctccggagccaacccacctgttttcattcctgcaacaggcctctgtcacaggatcactgtccaggggtaggggtcgccatgcccagaactcagcaagtgttcagctgactgcagcctcatcttcctgcgaggactcagagcggggcaggcgttctctgaagcccagagaggctttgccacttgcccagggccacagagctacggagcctgtgactggaacccggagccaagtctatggcctccacctggtggccgctgcctccaaaaactcccagctccacaagtcccgccctctgccttggcagggtttgcctggtgtcctacacacactgtactggtctttcagggtctaaacctctctttctcccttccttctggaatctgtctggggcccctgtgaggaagaaaaggctgctgggccaggacacttcatccattcattcattcctgacctttcttgcgtcctccgtgctaggcccgaaggagggtaggagtcttggtccctgcacacagcgagctttccctctggatgttgtgtcaggccacacactttagtcttccgtcttttcttcttcaccaagcatcccaccctaagcgcccgctcactcctgcctttatttcgggttttccctgacattcttctacctaacccactgcttttccccagctctctgcctcttggctgcttccagttcccgccattactcacaacgctgtcacatcagtcagggtcccatagggaaacagatggcttcctcaaattagggaaattccaggaaggcgatttacaaagggggatgcttacagaaggaaggggggaccactaggggagggcaggactctgggaccagcattagggggactctttccaccatcagggctggaaggaagagaaaggggagctctccagcaaagaagaaagtccagaggaggctggcctggagggcagtggcattggtcagaggcaggcccaaagagggaggggatccattcccgcatcgctccctctcctgcctttgacctcccacagggcacctccacatctggctgcagcccatggaggtggccccaaaaggcaaaagcagggtgaaggatggagcatcaatctgggaggacgagagccggacacccagcacaggtgtgcaggaaacttctgcacaaacacctttcttctttgtagggggtttctgtagtatgagacatcaagagaattcctgagccagagccttcctggtttgtaagaacaactgcattttaacagaaccccaaaatacgtatgtcactaccccactgaaggcccttccatagcaccatctatggctgtcatgtaacagccacacctggtggcctcgccggcagtgccccaactctgctcccagcaagccagactgctgtgttctccacagcccctgtggtccgggctgtggctctccaaggcccctctcttccattctaggtggatctgctgacacgtggtctgtccttcaaggcctcctccgatagtgcaaatgtatttccaaataccaccaccttaagggttaggatttcaacacatgaatttggggagagcacattcagtccataacaagcagagcctcatgaatgggattaatgcccttataaaaggggtcttagagagacccctcaccccttctggcatgtgtggacactgtcaaaaggtgctgtcgaccgggtgcggtggctcacgcctgtaatcccagcactttggaaggctgaggcgggcggatcacctgaggtcaagagttcaagaccagcctgaccaacatgacaaaaccccgtctctactaaaaacacaaaaattagccggacgtggtgggcacctgtaatcccagctactcaggaggctgaggcaggagaatcacttgaacccggaagcgaaggttgcagtgagccaaggtcgtgctgctgcaccccagcctagcgacagagcaagactccatctcaaaaaaaaaaaaaaaaaaaaaaaaaggtactgtctatgaagctgaagcagaaagcaggccctccttagaccctgcacctgctgctgccctgactttggactttccagtctgcagaactgtgagaaatacatttttgttgttgacaagcacccagttaatgatactttgttacagcagctgcaactaagacaccacccctacactaccccactcactcccgattccccaaaccctgtgcagaacttagcagtgcctagccacatcccttagcagtgcctagccacatcccttagcagtgcctagccacatccctaaagccgctgcttctccatcttcagcacctgagaatcgcctggagggctgggtccatccccagggcgtctgctccagtaggtctgggatgggcccaagtattcgcatttctaacaagttcccctgtgctgctgatgctgctggtccagggaccacacttggagagccactgccccaggctgtccccacccgacccgtctggcagcccctgaggctgtgggaggccactccaccacgatggctgctgcataggagcagtcctcacaaagactggggctggagggtccccggccccctcccctgacgggccggctctgcttggatgcacgttccacacagctgcccagaggccactgagcccaggcaggcgcagggtaccctgttcagctatgcaccctgtcctctctccttccctcctcatctcgcttcctaggatcactttccagacccacagctggccctggaatcccagtttctgggctcaccctctggacagccaacccaggatgctctgttctactttttctctttcccctaacatatattgccttctaatataacattttattcacatattatatatatatatatatatatatatatatatatatatatatatatatatatatattttttttttttttttttttttttttttttttgagacggagtttcactcttgtcgccccagctggagtgcaatggcgcgatcttggctcaccgcaacctccgcctccggggttcaagcgattctcctgcctcagcctctccagtagctgggattataggcatgtgccaccacgcctggctaattttgtatttttagtagagacggggtttctccatgttggtcaggatggtctcgaactcccgacctcaggtgatccacctgtctcggcctcccaaagtgctgggattacaggcatgagccaccatgcctggtcttattatatttattgtttattgtcttgctcctagtaaaatataagttccaggagagcagggatctgtatatgtgtcccaagcacttaaaacagtgcctgacactcagtaagtaaccactaaggaaggaagggaggaagggagggagggaaggaagggaagggggaggaaggaaggaagtgagggagccaggggagggagggagcgagtggagggaaggagccagggagggagggagggaaggaaggaaaggaaggaccacatgagctggccgggtggggacagatgtggggccttcctggcacctggtcccataaacctctgcaggtgtttagtgaatgttgagggtggggaagggaaagggaaggaggcctgagaagaaggggtgcctcttctcggctgacctctgaaattggctgaccacctccttggaggacaactccttggctccctcacaggtaactaaggggtggagagtgttgccagttctgcccagtgaagctgctggcaaaccattcccagctcagaccatccctgctcgctcccttgccagtgtctagcctctgtgctccctcggcacccacctccctgcagtcccctgggtgggcacccaacggcctgcctccgtccaactctcggtccgaattctctgttccctggcccacctggaactctccgaccatctgtgctccctgtcacaggggctcctggtgggaggaagttgagcctggggagaagcgactcggctggcacgctggcttccagccctgccctgtccttcccgccggccagctgcttccaggtcaaccttgggtcccactcctgaggacaatgtcccttcactgtcccaagcaggagcgctgattccgtcatctgtcatgtacgaaaaccccttcttgaagcttctcagatgcccctgcctttcctggccaggggtttctctcctagtccgtctgctgtggtctttctagagggccgaatcaaggccagttctgagtgctccttaatttatttttatgttgaaatttaattttgattttcaaaattgtcattgcatcattcccaagtgtttcaaaggattttatctcacttgccggtcgctataatcctgtgaaggaaataccatttctccttcattacagatgaggatatggaggctttccgggtctttcagcctctgagtgggagagccaagattcaaatccagctcttctgactctaaatcctgcactctctacaatgtatacactttgcattgttttatgagctcaggatccatttggcagtaactacttggatattttgtagcaagaagttagcaaaatgtgctttcttttctttctttcttttttttttttttttggagatggagtctcgctgttgcccaggctggagtgcagtggcgcaatcttggctggatctcagctcactgcaggctccgccccctgggttcacgccattctcctgcctcagcctcctgagcagctgggactacaggcgcccgccacctcgcccggctaattttttgtatttttagtagagacggggtttcaccatgttagccaggatggtctcgatctcctgacctcgtgatctgcccgcctcggcctcccaaagtgctgggattacaggcgtgagccaccgcgcccggcccaaaatgtgctttctttcacacagtacctatgagcttggactgtggagctagagaacatctgccacttagtttcggctgtgtaattttgggccagttacataacgtttctgtgccttagtttgctcacctgtagatggggataataacagtgcctccctcaaggattattattattattattattattattattattattattattatttttgagacagagtcttgctctgtcacctaggctggagtgcagtggtaagatctcggctcactgcaacctccacctctcgggttcaagcaattctcctgcctcagcctcccaagtagctgggactacaagcgtgcaccaccatgcccagctaatttttgtatttttagtagagacgaagtttcaccatgttggccaggctggtctcaaacacctgaccttaggtgatccacccgccttggcctcgcaaagtgctgggattacagtagtgagccacagcgcccagcctccctcaaggatttttgtcagttacatgaaacaatgtgtgcatcacatggtgaacaccacatcggcatttgctgtgtccctgcactgggtgagacgctgctgcctgctagggagggccccatctcatggccagccagctcatctgctgatctgccttgagtgagaaggctgccgacctgaccttgaaacactcccaccagctcaacagcagcatcttctcactggctcacccacaccagccttccccacatagacatgagtacagaggggaacagggtgatctgtcctttttgccaacaccagagaaggcagctggcagtggcatttggagataaggtggctgactgctgcaattggtgctggggtgcctgagatggttctgaaaagttcaggaaacacctctcaagtgaagtaggaggacatggtgcatacctcccagaaacgctgaaaggaagttgctggccccttagcctgcccggagccaggggtctgctcagctgagcgaggtctgaagagcacaggcaaggccaggaggggctttgctgaaggatgttggtcttgaaagacgggtccagctggggccaggggggaatttacacacacacacacacccccacatacatgcacataccggcggatgtcttgaggccaggagtttgagatcaggctggccaacatggtgaaaccccatccctactaaaaatagacaaattagcgaggtgtggtggcacgcacctgtaatcccagctactcgggaggctggggcacaagaattgatttaacctgggaggtggagattgaagtaagcctagatcatgccactgcactccagcctggaaaacagaacgagactctgtctccaaaaaaatcatcatcataataataatccatgtacttgtgtcaccagtagagggtcttgactgcaagttttccaggttcttggcgttttgaacaaagaattggacaaaatgcccagcaacgcaaagaaagaatgaagcaatgaaagaacgaaagcagggatttactgaaaatgaaagtacactccacagtgtggaagcagctggagcagctcaagagcccggatacagaatcttctcgggttcaaatacccactacaggtttcctattggccacttggtagtcaccttatgtaaatgaagcagtggcccacaattggttgcggaaagcagtcaatcagaggctgaagtgaagttacaaaggtcacactcctgtgcaaacatctgattggctatagaaagtgaccaatcagaggctaaagttacaaagttatactcctgtgcaaatgaagactcggtcaccattcagtctgattggttgccaacagccaatttcccatctgccatgaagaaaaggtgtgggttcaagccaggtgcagtggctcacgcttgtaatcccagcactttaggaaactgaggagagcggatcacttgaggtcagaagttcaggaccagcctggccaacatggcgaaaccccatctctactaaaaatacaaaaaaattagttgggcgtggtggtggcacctgcctgtggtcccagctactcgggaggctgaggcaggagaatcgcttggacttgggaggcagaggttgcagtgagccaagatcatgccactggcactccagcctcgaccacagagaccctgtctccaaaaaaaaaaaaaaaaaaaggaggtttgcaaaagaagtagcttcggctccttttgttatttaggcttggaaagttagggttttcttttcaatttagttctaggaagttggtgtgaaatgcccttagattccctgcctccagaccctgttctgcctggcttgattttttaaaaatattatgataggctttattttttagagaagttttaggttcacagccaaatggagtggaagacacagagctctcccatagaccgctgtccctccaccccatgcagcctcctccactgccaacatctcccctgacagtggcacgtttgttacaatcaatgaaccttcattgacacatcatgatctccagagtccatagtttacattcgggctcacgcttgctctcatacattctatgggtttggacaaatgcataaccatatgtatctgccactctagtgtcatacagagtagtttctctgtcctaaaaatcccccgtgctccactattcatccctccctccccaacttcgggcaaccactgaccttatgctgtctccgtagttttgcttgttacagaatgtcctgtactgaaatcatacagtatgtaggcttttcattttttcgtattttgggtttttgtttttttttttcaaatagggcctcactcggccaggtgcagtggctcacgcctgtaatcccagcactttgggaggccgaagcagtcggatcacgaggtcaggagatcaagaccatcctggctaacacggtgaaaccccgtctctactaaaaatacaaaaaaaaaaaaaaaaaaaaaattagccaggcatggtggtgggcgcctgtagtcccagctactcgggaggctgaggcaggagaatggcgtgaacccgggaggcagagcttgcagtgagccgagatcacaccactgcactccagcctgggtgacagagcgagagtccgtctcaaaaaaacaaacaaacaaacaaaacacacaaatagggtctcactctgtcacccgggctggagggcaatagtgcaatcttggcttactacagcctcaacctcctgtgctcaggccatcctcccatctcagcctcccaagcaactgggaccacaaggtgcacaccgtcacactggctaattttgttgattttttgtagagatgggggtcttactatgtttcccaggctggtctcaaactcctgggttcaagtgatccttctgcctcagcttcccaaattgctgggattacaggccatgagccactgtgcccagccatgtctttttatgtttgatagctcatttatttttagtgctgaaaaatatttcattctctggatgtaccacagtttatttatccattgacctactgaaggacatcttggttgcttccaagtttggcaattatgcataaagctgccatggccatctgtgtacagatttttttttttttttttttttttttgagacagtctcactctgtcgcccaggctggagtgcagtggcgcgatctcagctcactgcaagctccacctcccgggttcaagccattcttctgcctcagcctcccgagtagctgggactacaggcacacaccaccacgcccagctaattttttgtattttttttttagtagagatggggtttcaccatgttggccaggatggtctcgatctcttgaccttgtgatccgcccgcctcggcctcccaaaatgctgggattacaggcgtgagccaccgtgcccggcccccttttttttttttgagatggattcttgctctgttgcccaggctggagggcagtggcaccatcttgactcactgcaacctctgtctcctgggttcaggcgattctcctgcctcagcctcagaaagtgctgggattacaggtgcatgccaccatgcccagcaaatttttgtatttttagtagagacagttttttaccatgttggccaggctggtcttgaactcctgacctcaggtgatcctcccacctcggcctcccaaagtgctaggattacaggcgtgagccaccgtgcctggccttcttataaaatttaatgtgtgtgtatatatagtcccacttctagtcatttacccttgagaaatgataacatatgttcatacaaagacccagcctgggtaatatggtgaaacctcatctctacaaaaaatctttttgtaatgcagcgtaaaaaataatgagttcatgtcctttgcagggacatggatgaagctggaagccatcattctcagcaaactaacacaggaacagaaaaccaaacaccgcatgttctcacttataagtgggagttgaacaatgagaacacatggacccagggaggggaacatcacacagtggggcctgtcaggggttggggaggcaaggggagggagagcattaggacaaatacctaatgcatgcagggcttaaaacctgagctgagatcgtgccactgcactccaacctgggtgacagagggagactccatctccaaaaaaaaaaaaagttgttcacctgtgacttctttttggtacttaacttttttttttttttttttttttgagacagagtctcgctctttcgcccaggctggagtgcagtggcgcgatctctgctcactgcaagctccgcctcccgggttcacaccattctcctgcctcagcctcccaagtagctgggattacaggtgcccaccaccacgcccggctaattttttgtattttcagtagagacggggtttcactgtgttagccaggatggtctcgatctcctgacctcgtgatccgcctgcctcggcctcccaaagtgctgggattacaggcgtgagccaccgcgcctggcctggtacttaacttgatagcattcacagctctccctggaggaaggtcacgcaattgtcacccacaacttttcaggtgagtgaacagagtcagaggagttgagcaactagctcaaggccacacagggactaggtggtaaggcagagacttgaccttgggccactgaccgaagacccgtgtgctgggagcccatgtcacaccatttatggaatgaggcccttggggtgggactcagctacctgccaagtagttttggggctgctgacgggaacttggaacttgctcctctttactggagccttccagagccaatgcctgcctccctcgtcccaagaaggaacagctttagcagggcaccacagaaaggactcccagctgggcgggggctgcggggggactccctgggcatcctggaaattgcacaagcccctggacagggatggtgcaggtcaccttctcccctgacgatgacgggccatgaccagtggctccagtcattccactctttttttttttttttttttttttttgagacggagtctcgctttgtcgccaggctatatagtgcagtggtgcgatctcggctcactgcaacctccacctcctgggttcaagcaattcttctgccccagcctcccaagtagctgggactacaggcgcacgccaccatgcccagctaatttttgtatttttagtgcagacggggtttcatcatgttggccaggatggtctcgatctattggcctcacgatccgcctgcctcagcctcccaaagtgctgggattacaggtgtgagccactgcggctggccttttttttttttttttgagacagagtgtctctctgtcacccaggatctcagctcattgcaacctctgtctcccgggttcaagcaattcttctgcctcagcctcctgagtagctgggactgcagacgcccaccaccatgtccagccaatttttgtatttttagtagagatggggttacaccatattggccaggttggtctggtctcgaactcctgacctggtgatctgcctgccttggcctcccaaaatgctgggattacaggcgtgagccaccgagccggttggccattttggtcttgaaaacccagggacacactgcagggctgggggggtgggggggcaggggactcacaggatgttctgtagaagagtggaggacctgcagctatgcctggaggagcagcgaggcgctccattgctggaaggacgctgagaggggttcaaacatgggcagatgttccagaaccttcctgctggaagccttcccaggcaccttccgccacctcctgaccccctcgaaggtgtgtggacttgttaggtagctctgactttgctttgtggggtgctgcctaatccttcctcccctgcgccctggctggagctccccggggcctttcacacacattgtcctttcatcctcaaacagtctccaggaagcaagcactgctgtcattcctacttgacagatgaggaaaccaaggccgagagaggcgaattaaccagccattaggtcacacaggcgggatggggcctggagcccctgcaacctcagactcagctccaggtgctcccaaacctatgggcagtggtgactgtgcatttccaccatcaaagcagccttgcacagggcccagctgagtggagtgccaggcagtgccgggagggaggcggggctgggggctggcagtcacgcctgggcctgcaggcactggctcggggcctgctatcccaggagaaacaatcatctggctcgttgtcaggctcggatttcttacctcctcagaggggcgcgtgccaccggctggccatggggagagctcagtggagctggctcctctgaggcctctcttggagcagggcccctggtctccaatcccctgacttccatgcccctgtgccctcctggtcttaggcactgaccagacccgactgtaactgggcagtggtgctgccctagaagggctgatcttgcaggccaacagtgtagggtgtgtgtctgggaggtggttccccaggcctccctggtgctgcttcagagcttgacacagaagtgacctgctggtgtctgcagggccccaagtgctgaaggaggcctgccctggctcctgctcccctcggccctccattccaactcctctggcttcacctcccgctcatcattcccttgcctgccctccgggcccatccttgctcatgctgttggttgatcccaacacgtccctgcttccatcctcgctagtgaaaattggacacggccttcaaggttcagctcaggcacttcctcctccaagaaactgttcctgatctacctagtctcagggaggccagcctcgcccacaattcctgctctcctgggccccatcacccagctcagaaactcagggcaggccggagggaaggagatgggctgagccctcggaccccctcacctgggggctcaccctcggcttcactttaagggatctcctgccccaagactggagatgctccaaggctctggcagggcacacctggctgcccaggaatacagggaggggacttcagcaccctgcccactctgggcccccagggcctacactcccacccgacaaggatggctactcactgacagtgacttactcaccctggccctcagtctcttcatttgtgcattggagataatgaaacttacttcaaagcccaggtacgtgctgccaaagtgcaggttgcagcatgtcaggcctctttaactgtaccgggcttcacacctattggtagttactgggagctgctactaatgacatccgttcctcattcctgcccatgagcaagagccagtgctgggtgctggtgcctgggggagagggcggtgacggcaacccctggctctgcctcatcccaccttcaggcaccaactctgatgtcctcaccctgacctcctccctctccctcttctctgttcccatggtcacatgtgccaccccccatgtacatgtctgttgttctactgtgtgtctgtacctctctgtgaccccatcactctgcaagggcctgggcaagctggggctcagggcggtcagggctggcctaaagacatagcgaagtcggccgggcgcggtggctcacgcctgtaatcccagcactctggggggccgaggcgggtggatcacgcggtcaggagatcgagaccatcctggctaacacggcgaaagcccgtctctactaaaaatacaaaaaaattagccacgtgtgatggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaagacggcaaactggggcagcgttgggtggcaacaagccaaaccagggaccttaaaccaggtctttggtttgatctcaggtggggatctgggttccggaaggctccaagagctgcagttacaggttagttttcaggacagcgtgcagggcatcctggggacacggctgggcatcctgcagcctgccccggctggagctccggtgtctgggtgtctgtagcagcctgtgtggcaggggtgggggatggggcgagttactctccacaaagggcttctgggaaatcaagcagcactcgctctgctgggtcttcaaggaaagggacagggcccaaagactcacggtgctacgactgtcccggggcatccctgggctttctctggataccagcccctttgctgtaccccctggtccctgcacagcccaggcccctgctgcccctcttcatggacagcagtgccattcactggggttcctgtccccagccacaccctttccgcatactcacacagtggcctgttgaaactcaaatctgatcagcccatccatcctgaaacctttctggcttctgattgcctgcaggataaagtccaacctccttttcgtgacattcaaggctctttgtctcttccttcaatgtctgaactgccctgaagagaggagggatggggtgttccatagacaggaggtggtagtgcggggccctgtcaagatgtgggctcttgaggctccaccgtccaactccctccaggcctggtctcaggggaccttacaggaaaagtctggccttggtcagaaaagcctagaggttggccacaggctggtacgtgggggcccagaactgggcctctgacccctgcagagggagtctcaggcctggcctggctccctgccacaggatccctagagccacatgactggtcctactctccccattcccctgctgggctccagctcagtcgcaggagccaagccagatttgaggccagagggcttgaccaggttggttcctgctaggtggctctgcgcagaaccctcttacagcccatccaactggccgggtcccttcccttttgtaccattcttgttggtccctgtctgcctgaccctgtgtggcacctcagggctgcagccttggtctgggtcccagccactggtcaccttctgccctgaggcctgccctccctgctgtctggggctgtcagctggaccttggagcatggccatcccaggcccattcctggctctgaccactgtgaggggccctggtaccatcctccctgggcacaatccccctggatgctggctggtcaggtggaatcacttgttagcggagtataacggagtaacaagccaggcgaggtggctaatcccaatactttgggaggccaaggtgggaggatcgcttgaggccaggaggctgaggctgcagtgagctatgatagtgccactgtgctctagcctgggcaacagagcgaaaccctgtctaaacaaaacctaaaaaccccccaaaaacccaaaaaccaaaacaaaaagaaaactatccttgacactttagtgtaagtacatctaatgatagctgtaattatttcgaaagcatatgttgttacgagtatggggacatctggactttctcttgtaggagtgcatccttgcaggtatctttaggctgttcccttaattgtaagcttcttgtgaccacaagttgtggctggcaaggaatgtgccttgttagtctcaggatggagatgaacttacaatggcattgctctggctgtcctgggctcctgcttccctaatgcgctgggcgctgtggctcaagcctataatcccagcactttgggagccccaggaaggaggatcgcttgagctcaggagttcaaaaccagcctgggcaaaacatattgagaccccatctctacaaaaaattgaaaaaaaaaaaaagccaggcatggtggcttgcgcctgtagtcccagatactggggaggctgaggtaggagggtctcttgagcctgggaggtggaggctgcagtaagcagagatcagtccctgttaaaaaaaaaaaaaaagtgacagtccccaggaaggtgcaggtcgatggtggcagccactgtggtggcttgtggctggtgttcttgtcctatgtttgtagccatccctaggtccagggttcagggcttcctgttcccaggagggttcagataagaggccccgagcagccactcaggcagagcctcttcctggggagaaggtgctccctggggcgagcaagtgggcaggccttggctctctccattcctgaataccttctactgtctaggtagtagaacaccttctactgaccctggcccaggctcagatacggtccaacccggcagacccttcccgggggcctgtgacggtcccaggcagggagagccacgtcggggtggtggtcacccccagcgccctgaacctgcgaaggcccagtgtaggggtgagcgcgcaccggctggggggacgttggagaagccaagcagaggcagccgggcgcgccttcctgccctcccggtggaggaggacgcggcagggacaggcgggcggccagccggcttcaggacgcttgacaagggttttggctgagggtgcgccctgggctctggagcgcccaggtgccccgccacccacggggggcgtggtatgggggcgtggcctgggcgtggccggcaccgcctcttccctttcctgagtccagagggcccctcctgcccgccacgtttccttcctgctggggggcttctgttctcccagaccgggtcggtgctcttttcccccggcgcccctcccccacccagcccgggccttgcctgccgcagccaccttcttctctgatgctgtgtcctggacttggtgacaatggcaaattgacaagaaggcgagcctgggcctttcctgcggcgacatccagcttcccccgcccctccctgggtgggtgcccaccacacgcccagcctgccgcgtgcttatccaggccctccaggccaggcctccgggtcttatggaagaaggccccgtgtctgggcagtgccgtggctgtgagtgagcatccggggccagtcagatgtgccgtctccggaggtcacttccatagtggccatcaacagcttggccaaactcggccgcaggatcttttcctatcaattgcaggatggactcttcccgcagccatgcgacctgtggcccgcggtcctgctccctgagctggaggaggctgaacagaatgagcaggttgaggcctgtgggaaggaagagccacatctccttcatgtttattaccccctccgcaggccatagctaggaggccttgaaggtttttttaagggggaaagggggtttccagaaccacagccggctcagcagaaagtctccaccaacagaatctgtgggcgcacattcctcaacagctgaagaaggggctggaggggctcatggcatcccctccagaggcaggcccagggccctgtgtgcagtggggggtcctgcatctgcattgttgttaagaaagtgacatttggctacatggagtgactcatgcctgtaatcccagcactttgggaggctgaagctgtcagattgcttgggcccaggagttcgagatcagcctgggcaacttggtgaaacctcatttctttttttttgagacagggtctcactctgtagccaagactggagtgcagtggcacaatctcggctcaccgcaacctccacttcccaggctcaagtgattctcctgactcagcctcccgagtagctgggattacaggtgtgcaccaccacgcctgactaatttttgtattgttagtagagacggggtttcaccatgttggccaggttggtgttgaactcctgacttcaaatgatccacctgccttggcctcccaaagtgctgggattacaggcctgagccactgcgcccggacttttttttttttttgagatggagtttcgctctgtcacccaggctggagtgtggtggcatgatctcggctcactgcaacctccacctcccagggtcaagtgattctcctgggtcagcctccggagtagctgggattacaggtacgtaccatcatgcctggctaatttttgtatttttagtagagacagggtttcaccacgtctgccacgctggtcttggactcctgacctcaagtgatctgcccacctcggcctcccaaagtgctggaattacaggtgtgagccaccatgcccagccctcatttctacaaaacatacaaaaattagccaggcttggcacacacctgtagtcccaagtactcaagaggatgaagtgggaggttcacttgagcctggggaggtagaggctgcagtgaaccatgttcttgccactgcactccagcctgtgtgacagtgaggccctgtctcaaaaaaaaaaaaaaggcaacacttcttgaggctgctggtttttcagccctgctgtgctgcatgcttttggcgctcactctaattcacagggcctcgagggcgagacttcggctcacagctgtatcccagggcctagaactgtgtctgacatataccaggtactcaataaacccttgtcacacaaacccccaagaacatttcacaatgcttttcttttttctttttttttttttttttttttttttttttgagacagagtcttgctctatcgcccaggctggagtgcagtggcgcgatcccggctcactgcaaactctgcctcctgggttcacgccattcttctgcctcagcctcccgagtagctgggactacaggcgcctgccaccgcacccggctaatgttttgtatttttagtagagatggggtttcaccgtgttagccaggatggtctcgatttcctgacctcgtgatccacccgcctcggcctcccaaagtgctgggattacaggcatgagccaccacgcccagccttttcttttttttcgagtgcagtggcgcgatcttggttcactgcaacctctgcctccctagctcaagcgatcctcccacctcagccttccgagtagctgggaccacaggcacgtaccaccatgcctggctaattttttgtatttttagtagagacaggtttttgccatgttgcccaggatggtctcaaactcctgagctcaagccatccacccacctcagcctctcaaagcgctgggattacaggcatgagccaccagactcagccttgtttctcatttatacaggtagcgattggaggctcaggaagggaattcattgcccaaggttgaacactcagtgggagaagcaggccaggacacaagcaggaggggctccaaagctgagtttgttgctgcagagcctttcctgaggttggggagggtgtctgcagaaggaggctggagactgctgtagaatcactactactggtgacatcgttgttcttctctgacctgacccctgagttggtcagacttggccatgtggacaaccccctgcttctcccactctctgctgccctaacctgagactggttattcaagtgtcttcctcactgtctcccccaaacaggaagtattttttgatgctcttgcatctggggctgacccaacactgctcatcccatgtggtcattgctggcttacaggtcagtctggcccttgcattcgatgttctgtaaggacagagctcatggtgctggctctgagaaggaaacaggaagtggcagatggaagggtgggtaggtgggtaggtagatgaatggatgagccggcggatgagtgggcagatgtgtgtgtgtacggacaggtgggtggatgcatggatggacaggtggatgaatagatgggcagatggatggataaatggaaaggtgggtgggtggatggatggatggatgggtgcgtggatggttggatggttggatggatggatggatggatagatgggtgggttggttggtggatatgtggatacatagatggattgatggacaagtggatgggtggatggatggatggattgatggacaggtgcatgggtgggtgagtgaatggatggatgggtcgatgagtgggtgagtagatagatggatggatggatggacaggtgggtgggggtggggtgggtggatggatggatggatggatgaataggtgggtgggtagacagatagatgggtgggtggatggccaggtatggtagctcacatctgtaatcccagcactttgggaggccaaggcgggcagatcacctgaggtcaggagtttgagaccagcctggccaatatggtgaaacctatctgtactagaaaaaaaaaatacaaaaaattagccaggcatggtggcatgtgcccgtaatcccagctacttaggaggctgaggcaggagaattgcttgaacccgggaggcgaaggctgcagtgagccgagatcatgccactgcactctagcctgggcaacagagtgagacgtctcaaacaaaaaaaaaaagatgggtgggtaggtggataaataggtggatgggtggatgggtggatgggtggatggatgggtagatggatgggtggatgggtggatgggtgggtgggtggatgggtggttggatggatgggtggatgggtggttgggtgggtgggtgggtggatgggtggttgggcgggtgggtggatggggaggtgggtggataggtggatgggtgggtggatgggtgggtgaatggtgtgttctcagcagcagccagaggaccactcctgtctccctgtatatgctgatttgctggggtttctggccagaaagaatcatataggctgtccataaaacagctggagaggtgggtaaagtttaccctgcagatgacaaggctcaggggagcaggagagctgcctttgaatatttagaggactgtcccttgggagtaggcaaggacacccctcctgagcctcacggctccacaggtggaccaagaaccagtggcagaagtaccagggaggcagatggtttcttgaggctcaagctgcctgctggtttcagacaccttctcttctggggcttctgccaaatggtaaatggaacccgatctttttgcaaacttacatttttagttctgaaattgttgatgactccaaacatttttataattaacaaagtgtcttggctgggcatgatggcttaggcctgaaatcccagtgctttgggaggtcagggtgggaggatcacttgaggccaggagttccacactagcctaggcagcatggtgagactctgtctctacaaaaagttgtttaaaaaagtagccagaagtggtgatgcacgtctatggtctcagctactcgggaggctgaggtaggaggattgcttgaggcagggagtttgaggctgcagtgagctgtgatcttgccactacattccagcctgggtagcagaaagaaaccctgtctgtaaatgaacaaacaaatcaacaaagcatctttttttaaaaaataattttatacttaaacatattaaaaattatattattgtaatagagatagggtctcactgtgttgcccaggctgatctcaaactcctgggctcaagccaccctcctgccttggcctcccaaaattctggagttataggcgcaagccaacgtagctggccaacaaagtgtcctttgaatgaaagcaaaacagtcatagtcataaatgacacagagatttttttttttttttttgagacggagtctcgctgtcacccaggctggagtgcagtggcgcgatcttggctcactgcaagctccgcctcccgggtcacgccattctcctgcctcagcctcctgagtagctgggactataggcgcccaccaccatgcctggctaatttttgtatttttagtagagatggggtttcaccgtgttagccaggatttcctgacctcgtgatccacccgcctaggcctcccaaagtgctgggattacagacgtgagccaccgcacccggccgacacagagatgtttatgatgggaagtaacactgtgcccccaacctccccaccccagtttttcttcccagggtctccccaagagctgcttcctttgactcctgctgtgtgtagttctgctgacaatgacctggacagctctgcgccatgcacagcgtctcttttctccgacttaccaaattttagacactactgactcctccatgtgaaagatgggaattcagctacatcacattaccctacaaactttattgttaatgtaattatttttatttcttctactgcttttttggtaactttatttatttatttatttattatttattttcgagatgcaatttcgctcttattgcccaggctggagtgcagcggcacagtctcggctcactgcaacctctgccttctgggttcaagtgattttcttgcctcagcctcccgagtagctgggattacaggtgcccaccactacgcccagctaattttctatttttagtagagacggagtttcactatgttggttgggctggtctcgaactcctgacctcaggtgatctgcccacctcagcctcccaaagtgctgggattacaggtgtgagccaccatgcccagactttttttttttttttttttttgagacagtttctctctgttgcctatgctggagtgcggtggcgtgatctcagctaactgcaacctctgcctcccgggttcaagtgactctcctgcctcagcctcccaagtagctaggcctacaggcgcgcaccactacacccagctaatttttgtatttttagtaaagatggggtttcaccacgttggccaggctggtctggaactcccgacctcaggtgatcgcccacctcagcctcccaaagtgctgggattacaggcttgaaccactgcgcccggcatatgttttaatttaatttttaaagacagggtcttgctctgtcacccaggatggagtgcagtggtgtggacacagctcactgcagcctcgaactccggggcccaatcgatcctcccacctagtcctcctgtgtgactgggactacaggcgtacaccacgctgccagctactttttgtatttttgcagagcggggtttcaccgtgttgctcaggctggtcttgaattcctgagcttaagtgatctgactgcctcagcctcccagattgctgggattacaggcatgagccactgctcccggcccttggtaactttaaataatattctttctgctattagggaaacaagagcctaggagagccagggtcacaacatcttaaaacaaacttcatcttaaaactagtaaaggacattccttgccagtcacatagtactgagatatttacaaatgagaaaacagcttaaaaatacctgcaaggacacactcccacaacgatgaaaagtccagatgttctgatagacacaataatatatgctttcaagataattctacttatgctgtttgtacctgcatactaaaatgtcaaggatagttttctttaaatcaaccgaataataaattctgtcatgctatcagcccacccgcgcacgtgggcacagcttagtttagtctttatacagataagacccccatataaaaaaaacttaaagcgggcgcattttctctgctttctgaggtcgtctcgctctgtaactgagtggctttcaataatgagcttttaggccaagtgcagtcgctcacgcctataatcccagcactttgggaggccgaggcaggcggatcaccagaggtcaggagttcgagaccagcctggctaacgtgctaaaatcccatctttactaaaaatgcgaaaattagccaggcgtggtggtgggggcctgtaatcccagctactcgggaggctgagacaggagaattgcttgaaaccgggaggcagagcttgcagtgagctgagatggtgacattgtactccagcctgggcaacagagtgagactccgtctcaaaaaaaaaaagaatatgtttactttcacactcacctctgacctcctcttgggaagacgaggttaccggtgccttcccttctcttccactttcagatttcttcccggtcagccccaaacactgaatgtaaatacggtccaacatcaacctgcaaacgaacactgacatgaaagtgcagttggaaaggatctcgcaaaggaacagaatctggtgatcctaatcgtaatgaacgtgatcgccgggtattgagagcttgcaggtaccagggctccggcactacgtgtttcacaggggccactcggtagacctcttggtgaccttgaggtcaggtaccacgttcccattttacagaggaggaaactgagataacctacgacagcgaaaaggtagcagagctgggactggtgcccaggctcgccgagtggaaaagccctcggccaccgtggagagctcgcttcctgtggtctgaagcgtcgcccctgcaccggcttctgctgccaaggatggcttttcctcactggtgcccacctacgctcacttgtgtcatgtggttaagcccttttggcaacataagacctttcccaagaatgtgcctcggtgcagaggaagacggtgggggcaggccccctccccgggatgctccaccctccctgacctcacacgggtgcaacctgggccgtggccgagacctgctgtgtggcagacaatgggaagcctgtgtgtcgtcctgggtgccggatttagacaatatttagctttcccttggtggaaaagcctttcccctcctgctttgggcaggaactggttcctgttgggcggggcctggctgctgccccacccccacccggccgggcaccttgaccggcagctctccgggctgctccctgcctgtgtccctgagcactgactccagaggtttaatcattaacgggcacgtttggccttcggtcgtgggctggaatttgggacctgtgcccgggaacaatgatctccgacacattattttgtgtaaaatcacttttagctgccattagctaataaagctggaataaagtgaggtccattaaccagcactggcctctcggcctctggggctccttgggagggacccaagggactcaccttttgaggaccgtgaaatcgccgctagaaaatgtgcttacaattgtggtccagcactgaagctgctcagtatgttttcagtcccctctgtggcaaccccgtgtgtggttttggggactggcagagtgccctggaagcgtgcccacgtgctgcagatccaccagaggaaatgctcgggaaacgctgacgcctgctttgccccctgtttcagggtcaccgaatgagaagctgttgggatgaatggctcccccaccctcctagcccgggccaggggtcgcccagcagcaatgcccacctcccttcgtcatgggaggagctagtgctccagtcagcccttttcatcctgagctgtttgctggaagtcaccagtgggtatccacagcgcaagcctcctctctctccttcccccaacctctgagacagctggctggatgctccctccaaccccattcccctgccctctcctgaggacagctctgtcgggagcagggcctcccagcaagagccagcagctgcgctgtttctgctgctccagcatttcgggggcagctggctggaagggtaggggcgatttagagaggcccactggcaggtgtggtgatgggactccatgtctcccgcatgggacgccccctcctccctgggcttcattcttagggtccccagtcattcttccctgggcacagccctccctctctgtgcctcattagctcatccccaagtccaccctacagctggtcacctccgtcttggtgcagcctgcctccatggccccgcctgaatgctgagtgcccaagggccagtgttgcaaggggaccccaccagcctttctacagaggcaaccagaaccctctggcctctccccatcttcctgccctcccacatttctgcctccctagctctgccccctgccccaggaagctgaggctgcaaactcagaatctgccttcgcctctggtgcgctgccaactcccccttgggcaggcctgtcgcctgcagcctgtgtctgtgctgccctccactgccgtggcagtgcccaggccaactggtcggcatgcttgggctcagggacaacttcacggtcagcacgtggctgtgcatggccttggacacctggaacgtggagccggtcagccagcagctttcagacagggaggggccgaagggtccaggccacacagagggccagggccagcagccaggcactggctgccaccacccgttttcccccagcagccctgggctctcccttggtggctctgctctgtgactgcgggctggttcttggacctcggttccctgctgttctgggaggctcggggcctagctgaacttggggccttcctgcctgccagcccctgactccggatggccagacacactcccagaaactccacccggcctcttgttggccaccggaagggctggcgagagctgcaggatgcgcacacccctattgagggcttgcccgctgcccctctgggagccttcctggaatccgggaaatgaaggcgctctcaggcaggacacccagtcagatccgtctcgtgcagggctccgggccccgttcctggccctgccagggaagccagacccggctgcccaagagcagaccctgcctgcagaagcgctcccaggggagacagccaggacctcactgggaacagaccccccaggttatttccaagcctgcccctcctttgcctccctgctgcctcctcataccccccccgcaccccggctgagagcagccaccgcccagcttgccctgccatggttctctgctcaggctacagccccctggattagagtggtttactggtctctgctacttttaggatcaaacctaaactcttaaagaacttgacccacaaagagctggctctgcagatccgtgggggaaaaggtagactactctgtacatagggtttggacaactctcaagagagaaagctggtttatttcacatcactgggagagatccactccagagggattaaataacttacaatatagaaaatattcgagtgtgggccctccttcacccccaaagtggggtggctctccagggtcatcactgaaaacactcgattgcataaaagccccgtcggctctgggcacagccaggaaggtgcatctccccagacaaacaagctgtattatctccagcatgtaggacagggaggtgatgttctccagatgttaggagctgcctcccactccccggccctgcccaggctgagtgcctgctgaatgctttatgtaagtgccaaatggcagcgcttgcaccctggggccggatggaacagcaaggaggcctcgggcctgggtgggggccttggggccctgctaacaccatgggaggacctgtgaggaccagccctggggaattgcacctggcctcaggccctcccctcctggcctgggacagaactgtacagcctactccagttcagtgccaagtggagccactcctgcagggcagtgggctgggtagggatgccacatgtgagccgcagtcttggcagggacctggttaaccttgccctgcacgcaaggtagtccctggacaccacaaagaccaaccggctccagcccggtcccagggagcttgtctcagagaccggcaggcagggcaggcccgcttcagaagctgccctgacgggacattgcgcttgtcgaggcgacacagacagacctgatgcagcccctgccgctgctctgcgacccagttccctgagcttggcttctctcagctgtggacagggataagaatcagggcacctgcctcaagggtggctgtgagggtgagatggcgcagcccaggtgcccggacatagtcagcacttgggaaggtgccctgggtgtgccccaggtgcatagtgcacacagggtggggatgaggggctcccacaggtctggaagatttcctgggtctgcactgggtggcctgggctgacacgtgggcaagagcaccctggcctgcagggcacaggatgtacagaaactccaaggccagggggatggtgagaggctgtcccactacagggcctggagagccgctgtggtctgggagggacagcgtgccagactttcctcctgggagtctcctggcctcctgctgtctgtcatgaccgggagcctcccggcctcctgctgtctgtcatgaccgggagcctcccggcctcctgctgtctgtcatgaccgggagcctcccggcctcctgctgtctgtcatgaccgggagcctcccggcctcctgctgtctgtcatgactgggagcctcccggcctcctgctgtctgtcatgacctcctctggctcccagaaggcctgggctagttcatttcccctcaagattcccaagccaagggtgatggtgtatgcctgtagtcccagctactctggggctgagtcaggaggatcacctgagcccaggagtttgagtcctgaggaacatctctgaaaaaaaaaaattaattaaattagaaaacgattctcccagcactttgggaggctgaggcgggcagatcacttgaggtcaggagtttgtgactagcctggctaacagtgaaaccccgtatctaccaaaaatgcaaaaattagccaggcgtattggtgtacgccagctactccagaggctgaggcaggtggatcacctgaggtcaggagttcgagaccagcttggccaacatggtgaaaccctgtctctactaaaatacaaaaattagccaggcatggcggtgcatgtctgtaatcccagctactccttaggttgagacaggagaatagcttgaaaccgggaggtggagtttgcagtgagctgagatcatgctactgcattccagcctgggtgacagagcgagactccatctcaaaaataaaacaaaataaaattaaaattaaaaaagagtctcaagatgcccccaaaggacttggcaagtgcctagtaatgagggctctgtaaatgtccgtttgagaatctatctcgtctcaagattctcctcactctccttctccccgcactgctccagcgatgcatgagcttggtccttgaagttttttctttttttcttttcttgtttgtttgtttttgagacagggtcttggtgtgttgcccaggctggagggcagtggcaccatcttggctcactgcagcctcgacctaccaggctcaagtgattctcccacctcagcctcttgagtagctgggaccacaggtgcacaccaccacacctggctaatttttgtatttttgtagagacagggactcgttatgtttcccaggctggtctcaaactcctgggctcaagcgatcctcctgcctcaaaagtactgggattactactcagcctcctaaagtactgggattgcaggcgtgagccaccatgcctagctgggtttctttacagaagagggaagtgaggtttagggaggaaagagtttgcccagagtcccacagctggtccaaagcctgtcccaaagcccattgttctcccatggggcagccccggttctgccataattgctgtgtgtccctgggttaatcattttccctctctgggcctccatttccccatctgcaaaacgatgatgtctgaggccccttctggcttggatggctccacagtggactttcctgcctggtggctgtggcggctcctgaggagggggccctggcctcgcagggaggccagtcaccagcttcgctacgagatccagcatgccagccccaagccggatgcccttcatatggatcctcgaccaccaaatgctgcaaactcttcatgttaccgtcccttctccaggctctggttagagaaccagcattcagaaaagctgatccaggactcccaggaagcacagtggggggcaccctggcctctactcccctatcctttaagtagactctgccccagcctgatgaggttttatcaggggacctaacggggaccaaagaaggggctggtcttggctccatccacggccactaaggatggccccttctcataccatctcccaaattcctgtggcccagagtcccccccatgcctgctccctgccagctgtcagggagcctgggggaggtctccctccgatggtccctccagcaaactcctgcatgctcaggagcgtccttgtcctcccacagccgaggtcagggccggtggtgctgacctcgaaagtggccatggccatgccgcctctgctggcctgctccagcgggcgagtgccccaccctcgcctgcagccccaaggttcctgcatgcgggtgcctacctgtgagagggcagagggcagaccaagggcatggctcagcctggaggtgggagactctgatggcagccaccacaggggaccacaacggcagggtagagcccactgtgggggctcctagcccctacccttctccaggaatgtccctgacatggagtggcccaagtctggaccgggtcatcctgtcccacgggcttcagccgattggtcccccagtgggccctgactctagttgagggtcagactctcctcctgaagcctgatgggccagggaggagcccccggtttgtggggtaggtatgaggaagggccgtaactgcattgatggcaaaatgaatatgttaagagtccacatacaaaccttttcttcaacctaaaagtccattttctcctgattttagaataagtgaaatcatttccatgagcttcctgaaatatcaccagccccggcactgagctggctgtgcctcagggagacattgacctgcctagaggtggccccagtttcaaggctgcagactggaagggtgggctcccctttcacctggagacactccacctccttccaggagagtcttctttttgcctgagttgcgcccgaactggtgtctgagtgctggtggccgaaagaactgatagccaccgtccccccacggctgtgacctgtgaaccccgcggggccgtatcagttttcactgccgcagcaggaacgcatttcacaattcaccgagattccccccaagtgagagagacgcgatccctgcttctgtggatccacagccaggggcgccagagataaagctcagaattgttctttttaaagaaaaccaggccaggcaaggtgttgcacacccacagtcccagctactcgggaggctgaggcgggagaatcgcttgagcccaggattcctgtttgaggctgtggtgctctgatcgtgcctgtgaacagcttctgcactccagcctgggcaacacagcgagaccctgtctctagtgaaaacaaacaaacaaacaaacaaaaaagcgaggcagtctcctcttgattcctccagcccactccttcctcctctctggttcctctgggtctggcaggatgccgtgtgacagaatgcatctgggggtgggaagtgtggggtgcaagacagacagacatgtgggcagtggctgcggctaagcagaggcatccccaaggccgccctgcagcagaaggaccctctctggggaggtgtgtaggagccccccatttcatggttctgcccagaaagtgggatcaggcttgggtgagaagccaggccccatagagcccctcagcctttacctagaaccggaaaagaagcaggaagtatggatgtaagaatagacactccagccaggctgagcaggaccgggggcggcagcaccacgccttccatctgcctggaggcttgagggtgggcttccgcaggtccaagcccagcctggctgccccctgcctccctcccctttgctctctgggtacctctgggccaccaaggtgtctgggctggacactgtggagggggcactgggattctctggggagaggggggccagccaggcaccgactgacagagctgaaactggcccagtgaggcggagtgggggttgggggacccggaccccacactctcaccacaggccaggcatctcctctgcctgggagccaacagatgggaccttgaggagcctgaagtcaaggcccatgagacttcccagccaggagggcgtgagcacactgtccgcacctgagcctccacctgtcgtgacaggtactgccagggccatgagacgaaagctcagagctcctggtgggagctcggtctcccgccccatccagctggagggtggatggtgccttctcacctctgccccctcatctacccagacacgctgtgccctcctcagctgcctctgacctctaacttttccctgccaggcaggtgagaccaaaggcctcaaaggggctcatgaatgccctccaggcctggcacctgctgtgcacccaccctggctgctgccctccctcctctcaccgtctggtggggcctccggctctcctccctctcccctcagctcgggctgagcctggccgacccaaaggacactgggctcagagttaggagactggcagtgcgttctggccgccctgctgactaggccatcagggcccctctggagcctccatgagagaatggggttggggggacctagctgtgcaaactgtaaagagccacaccctgcaggaaggtctctaggaggcagcagcagaaactccccaagctcctgcaggatggcccccggtgatgtttgtctccttttttctttttgagaccatgtcttcctctgtcacccaggctggagtgcagtgccgtgatttgcaacctcgacctcctgggctcaggtgatcctcccagctcagcctcctgagtagctgggaccacaggtgtgtgctatcatgcccgggtaatttttatattttttggtctcactatgttgcccaggctggtctcaaactcctgggctcaagtgatcctcctgcctcagcctcccaaagtgttggattagaggcatgagccaccttgcacgtttgcctcctgacctcaggtccccacggagttggtcatcttctgggcctcgctcagccggtgctgaaggtgagtcatgctcgatgatgacctgaggagcagaagaaggtgcaggtgagtcacctgaggggaactgggtcatgaccagagctgtcaccgctaggccagagcacaagagtgacatcacagccagtggtctcctggcagggacaggaagcacctgccatgcttcccagcggccgtccctctgtccaccgtctgttccccggggcctatgctgggcctcacggctgagaggcagaggggctgaggcccaagttcaggctcatgggaattgcgggcacagagcaggaggcagggccatgcctggagcctccctcaccaaaagcctccactataagcctttaccaccttccagtgagttacacgtggggttctcaagtgaaaggctgcactgtgaaatgtaaacttccaggcagatcatggtgtttgatttgacacgccctccccgtcttcttttttttttttttccatgacggagtctcgctctgtcgcccaggctggagcccagtggcggatctcagctcactgcaagctccgcctcccgggttcacgccattctcctgcctcagcctcctgagtagctgggactacaggcacccgccgccacgcccagctgtttttttttttttttgtattttcagtagagacagaatttcactgtgttagccaggatggtctcgatatcctgacctcgtgatccgcccacctcagcctcccaaagtgctgggattacaggcctgagccaccgcacctggcctttttttttttttttaaacccaaatcctcatacaatgcaaatatctgtggcatctaaggctcctgggaagccccttagagggtccaagctcccatggctgggacgagggtgcagggtgcagccagccagcccccccgggtggcattgtggtaggccgggccgcagccttgcagaaggctggtgggcccttagaggccgtggccctcaatgctctgccccaggagaacatgactcacctcgtgcagtgaccagctctgctctgccagctcctctgtgtacatgggggaaataggccgccagtgcacacgttggtctgggactgagggatcacgcatatggctcagtggggtgctgcctgagggccggtccactcacgccacccagacaccaagggcagggtggaagcaaggtctctttttccttcctggcggaggcagcctccacacggcctcagcgggggacctggggcaaagggctgagattgggagaatgggggcccgtacagcccctgggcaggacagtgcactgcagtggaagccgaggagtgcatggacttcttcagggttcgaggctcggccgtgggcggaacgccagtgcctgtggtcggggtggtcaggcctggacacggagactctgatctcaccgggagttccccaagccccgcccacagcacgatcctatcatctgctgcccgccccagctggaccggggctattacattattgtttgtaaagcgtcctgttgttattttctgattaccaaggcggtacatgttcacttaagcaccgcgtgggtggtggtatttgctccagttggtggatggggcggtgacttgcccagttgcagttcatcagcatcagcagcagtgatagcaaaaaggattcagtcggtgtccctcagacgcagcactggcagggccattggcagagactcagtgagccccagccccttccgacctaaagctgaccacaaattcgggtattttctagacaactgggtgcggcagccgggacccaccccaggccagccttgtttctccagctgtctcctgctgtgggtctggggatggggatggaggcgtggaccccaaaactgctctgactgcctggagcctccccagtgatagaggaggccactgggagcacagggcccctctccccgacgggaaggcctctgacagcccattctaggcgggctgggcgcaaggctcctctggggaacccggagctcaggcaggaggcctgaagagtggctgcactgtgactgttttcctggccctgattttagggctgacccctcccctcaacacacaccccaccgtctcaaatcgtaatatccaaaggagcgtgggtcacctcagtgcattctcaggcagtctcaccatggcctgctgatgtggacgtcacaacctcatttgacagatgaggaaactgaggcttggggtggagatgaagttcctgactcagtcacacattgctaagtggctgaatctgacttgaacctggtgtcatgtgatgccagacagcccctctgtactgctacatgggcagcaggtctaggcaagaaagtgtcagcagctgggaggtgggaggggcggagggtcttcagcccgaccctgggccggggctcctgttctcacactgatttgggatgggtggcacagtggggtgctaggagctgggactctggcttcagatggcctgcgggtctgaatgcaggctctgctgaatgctagctgtgcgcccgtgggcaggtcacttcccctctcagtgcctcatttcctcatcctggaaagtggggaggatgaccttgtctacctcctgagctgctgtgagattaactgagctgacgttgctggtctgtgaatgctggccgtgatccctgggcaggtggagtagggttagcagcgtccaccttggggcaaggcccacctggcctggctcccagaggccacgcttcctggccaggatcctgagaaaggctgctccctggcctgcttggagctcagcacagagcctggcacgcagcaacaccaccctgtgtggcactgggggctcctgcctttcttgccctctggttcccacacccactgaggctgcccgcaagccctgccttcccacaggtgcatcagggggagcctcaggtgcccagtgtccacagttctccagcgagtgtctgacagataggctctgcccgtgaatgccgggatcctgtgagtctggcctagttcctacacttgcttttcctggccaggcctcagccaggacctatttcctaaccttcggccctggcctgggcactggttccctcccacctgccaaggacgtctctggtcctaggcttcccctgtccattgctggtgtcactccggcctgcccaggcagcttcctcctctgccctctaattgggctctgcaccctccccagcctcagctcctgccacagctctgctctccaggccctgaccctgtgcacccggcactgctgtctgcagacagcagttcttcccggatgctctggagtcccgcagagcctggcagcaggtgagacctccagggaggttgccctggaacttgtttttcctggtgccctcctggagactgcattccaccgggcctgacatacacctacgttcctcccaggtctctggggagatcctctggccaaggtgaccagagctggggaatgtgccccagtccacgggggaccctgggaactgcgcttttggctggaggctgcaccctagggccaggcccagagcaggggcttctgggagcagttgctgaaggtgcccacagggatgggtgattgtgggcacacttggctggcttagagacaccggggcgtttgggtccagaggcaggcttgggaaaagtcatcggaaaggggctggatgctggtctggggaggactaacggcagaaccccgaggatgccgccgacagcgcgggctccgaaagggcagcgggggtctggagttctgatctgaagctccaggaacaccctgctggggtgtttcaggtgtttgaaaaattctctaagttatttgttttctgttatttcttcatggttgggataccaggttctagggccgctttggtttggctctgtatttcattgtgtggctaatcaatttcggtctgacacactttctcttttgaagaaattattcatcagggtttggcgtgaggagcactattgcaggatcctcaggcatctccaaacattgaggcaacactgcggaagtggctcccagtgcccagggctgggggtgaaattcccctagtccagccctcactgcagcttcctgctgggctgcacgcctctccaggccagggcctgcctcggagtcatctctgacccagggtccagcttgaggccagcatggaggaggcagcagcacatgcttgttgaatgaataaatgacctggagtgaggtgctggggagacaggagtgagggcccaggcgcggccctcatcgggctctgagggtgtgattctcccacacccttgcaagaaggactctattttaaactttatttatttaaaatcgcacagtaattcttgaacgctctcataaaaattaaagcattaccaataaaattcaagtctatcttgatcaagaccctttggtcttgcccctcctggtttgtttgccgtctgcatatttgccagagttttccttgtgtggtgctgacatatatgaattcataattttctgaggcccgtggaaggcttgagcccaggagttcaagaccagcctgagcaacatggcagaaccccgtttctacaaaaattggcgggtgcctgtggtctcagcttcttgggaagctgagacaggaggatcgcttgagcccaggaggctgaggctgcagtgaaccatgatcacaccactgcactccagcctgggtgacagagtgagagcctgtctcaaaacccaccaaaatttgtaggttttttttttttttttttttttttttagcaaggtagtcttgctcttgtttgagaggtagtcttgcactccaggctggagtgcgatggcacgatattggctcactgaaacctctgcctcccaggttcaagcgattctcctgcctcagccggagtagctaggattacaggcatgtgctaccacacccggctaatttcgtatttttagtagagacaggggtttctccatgttggtcaagctagtcttgaactcccgacctcaggtgatccgcctgccttggcctcccaaagtgctgggattacaggcactgcacccagccttttttttttttttttttttgtcagatgaagtctcactgttgcccaggttggagtgcagtggcaccatcttggctgactgcaaccttcaacagctcccgagttcaaggagttctcctgtttcagctttctgagtagctgggattacaggtgtgcgctgccacacctggccaatttttttttttttttttttggtgttttagtagagatggggtttctccatggtggccaggctggtctcgaacacctgacctcaggtgatccacctgcctcggcctcctaaagtgctgagattacaggcgtgagccaccacactcggccagaatctgtagttttatttgtgtgtgagtgtgtgtgtctgtgtgcatgtgcctgcgtgtgcgtgttgtaaatcaagtgcgttgtgcaggcatgtgcacatatgttgtaaaataagtggcattgctctgtctgtcatcacgtaagctggctttcccattggctactggcccctggagcccttgctgtgtcagtatgtagagatctactctatgacccatgatagctgcagagggtccccagaccacagtggatgtccaccacaggaacaagcctgttttgtggatgaggaagtcgaggcttagaagttgggtgacttgtcaaaggtcgccacccacggtgagggccaggttctgggagggctgaggggcaggcatggtgagccagttccgggcatgaggcaaggcgtggcaggcctgggggcaaaagccacagcccgtgtggagggggtggggggatcgaggcctttgggaagcctgtggattctggctgcagtgtgggtgtgacactgagtgctccggggactccgagttatcacccaggcactggccagccccacgctccctcctccaggtacttggctccctgcctccttggccggcccgggctgggtaggtgtgcagggctggaggtgaccaggtcagcgctgctctcgaggacaggcggaagccccttcatgcccagcgggcccgggggtggggccaggcaccactccccacatctcccacgggagatcatcagtcctcaccgccataccagtgtgggggctgggtgtccaccctctaggacttaggtcaggaccaggcacacgtggggaaggccaggtcactgggcgggccgaggatgcaagctgccgcgcttcccatgaaggccctctggccaaggtgctaattagggcagcttcccgaggagagggaagagcaccctgaagtgacctctggccttcccaaacgcggtttccttctgactcagtactggcctgcctgtcagccagaaatcacccaagggccccacatggagggcacctgccaggtcatgggccttgccccattctccctaattgcgcctgcctcagctgacccacctccagtccgaggcatgtgtctcacggatgccagggtgcccccagggtgggggtggagaggcactcagggtgagctgagggtgtgtctctggtgccaagcctggcacagcgtccttggcctggtttccccagggctggctccacctggccaccttatacccgtcccactcagaggccaccagtgctcggtggcttaatggcaccacggcagacaggctctgtctctgtgtcactcaggatgtttgcataaagggtccataccagggaagagggatcttactccacagagccatggtcgtgatcggaaggctgcgcaccccaggccccctgctctggctgtgtggcttggacaggctacctgtggtcctgtgggtttcttttttttcctttttttttttttttttgagatagagtctcgctctgtcacccatgcttgagtgcagtggtgcgatcttggctcactgcaacctccgcctcttgggttcaagcgattctcctgccccagcctcctgagtagctgggattacaggtgtgtgccaccacactgggctaatttttgtacttttagtaaagacagagttttaccatgttggccaggctggtcttgaattcctgacctcaggtgatctgcccacctcagcctcccaaagtgctgggattacaagtgtgagccactgcacccagccgtcctgtgggttccttaagcgaaaaaatggacagtctaagaccagcctcacgcggctgttacctggaccaggcagaaccctgtgctcacagggaacgaggtccactgcaggctcctgcactggagtgccgtggcgccctccctcttctgtctgagccagcattgcctcccacatgaccccagtcccatcacatcccgtggggttcacactcctggccttcccaacctgactacatagctggattctccctcccctcccctcccctccccctttcttttcttttcttttctttttgagacagagtcttgccttgtagcccaggctggagtgcaatggcgtgatctcggctcactacaacctccgcctcccaggttgaagcgattctcctgcctcagcctctggagtagctgggattacaggtgccagccaccacgcccagctaatttttgtatctttagtagagaccaagtttcgtcgtattggccaggctggtctcgaactcctgacctcatgatctgcccaccttggcctctcaaagtgttgggattacaggcgtgagtcagccaccgcacccggcccagggagcattttatttttaagtgacagggtctcactctgtcactcaggctggattgcagttgtgtgatcatggctcactgcagccttgaccccctgggctcaagtgctcctcccacctcagcctcctgagtacctgggattactggcacgcaccaccctaggaatttaatttaatcatccagcactggtcagccccaggctccttcctccaggcacttggctccccatctcctcctcggctggtctgggctgggtaggtttgcagggctggactcagaaagttgtattttagcaaagctctctcccagacttgaaggtgcagcccagagtaagtgcttggagagctgtagcaccccttccaggaggatccgtgagacgtggtgagaccccagaggagacgggggtacctgtactgccatggccccacactgagggatgagcactgcctttgtgccagacgaggagagaaaccacagggtgtagcttggcaatgtggagacggatcccgccttccttccagccacatggagatggatctctccttccttcctgtcacgtggaaatagatcccaccttccttccccatcatgtgtggagacgtatcccgcctttcttccctgtcatgtggaaatggatcctgccttccttccccatcatgtggagatggatcctgccttccttccccgtcatgtggagatggatcccgccttccttccccgccatgtgggcctgtggggggagtgggagggacaggtagattccttttggtttcctgccagcccactcaatccctcactctggggagagcaaggataaactgtgtaggataaactcacccccaaagtggctaactggtagctgcaaggctgcatattccccaggcctgggccagacagttcccatcaaaggagagcctggtgctggtagggtctcccccaaaggatgctttgttcacccatggaaataaacacttcccctggatagttactcctgggactcgagtgtaatatggggtgtacgttactctttaacaggtgactccatccaggtcataaagctcttctgaactaagttcctggaagataggcgttaccacctccagcccgggtgtttattaaccactcccacggtggccacggagcagccaggggtagttgttgccaggacgctgggctcaccttctgaactttgtcctgagaaccagagcatggcgggccaccctcatcagctttccccaaaccagcagggagttggcacaagaccaggggcttggcaagggttgctttcctctgctgcagtgaggagcctccgtttaatccccacctcccccctctgcagccactttgaaagaactggagtgaacacaggctcctggcagggaggaggtgtctaaatcaccaggctggcctctggcaccgaggcccaaagcactctcaccgccattgccacccaaacctggacttccagaccagggccgctgggctgacaaccatgtgtcaacctttaaagatgaaataaaactgcatgaaaccgggaggtttaaaaaccaaaatataagggacccagatgggcgtctcaatggtggagagagacaatgagcagagctgtggggaaggaaacccctgaaaccctggcctgtcacgcggcatggatcaccggcggacaccaggcccgagggcagctcgcgcataggctggcgggagacctataggctggtgccgaagatgagccgggccagtcagatgtcccattcaggtttggaccataaacagaagagggaggctccttggagaagggaaatatggccaaaaggtcgtgtgggtgccatggggccccacacagcatcgtgaccctagtcaggaggagcggagcagcgtagcagggagcaggcacggggaggagagaggacagcttggaaatgggtcaaggaggccccagtgagacacagagccaagatcttctaggccgctctgtgtccagggccagccacagttctgggatccaggagtcctggggcccacagtgtcttcttggatccccaaaagatactgtgtcccgacagggccaacatgggtagatctcagcttcttttgatcccccgtgagaacatcttagaatgggcgtctgtggatactggagtctgttctccttccaggctccatggctgcctcggttcacaggctgggagatgaggagtggagttggggctgtcacttgcatgagacgagggtgggcctgtgtggcgagtatagaatcagtcaaacactcaccttctgatgaacttagatcaacttgtgttggctcaactgctgggcatgttgggacctgagagttgggtaggcatgtggggagaggtgggtataagcctggctcctaaagacagtggcaatctgcccaagggggctggtgagtgcaggcacagctcaggtgggaaggcacaccggaagggtgttctggtcagcagtgacagcagctacatctttgttttggtatatatatatgtatatgtaccatatattggagattggaggagagtccctcccctcctggagagaggggagcatggggagaaaggaaggatctctgaggcccagcttgatgctcagctcagggcaggaaaatagcggggaagcccagcctctttgcctgacacacatggtggagaggtggagggagactgaggctgagcccagcctccaggtctaccagaaattgagtttaagacaagaccaactgcgccccaggcacaggtaggggtggctccttgaatgctcccagccatcatcaggcctggagcagtgagcacacagccgggcctcgcctcctgcagcagggcaggcagggcggcaggggaggggaagggagcccagccccaggtatgcagcctcggtctgcggctgctctcctcacgacacctggaagctgggccggggggcttttcttctgaaggtgggtgcaccctgtgctgtatttggaggaaaattcagctgtgctgactgggcagaactgcgggtggttcaagtctttgcagaaggccttgctccaggcttccttcaaaggcaggctcttttaggtcagtgggctgcacttgagtatgcatcagaatctcctggagggctcctgaaacacaggcctgggccctatcacggagggcccaaagcaggtcttgggtggggcccaagaacctgcatttatgacaggttcccagatgctgctgctgtggccccaggaaaccctttgagaactgccactgcaggccatttcggttggaatttgatttgcaaacgttcacatctgcagttcctcttagaagggaaggcgccttctcaagcacaagtgaaacaactctctccacctgctggtgtgctggtgcttgggctgcggggaagggatgtgtgtgtgaggcagaggccctcaattcctccgggtggggtggggagatggcctggcagtacccatggctgggggcagagctatcctgtgggcctggggagcccgcctgggtgatgagacgtgctggcacaggctccgcagccggcagcgcctcgtcacaggggtgggcttcagaactgcttgggctggcatgagaggccgcgggtgctggcttccctggaaaagccactcagctttgagaccagagaggagatgcagacacaagccttcgtcttcaccccttttcgaaagagagaaagcccgaatctcaacaacagagtgtctctatcagtcccatggttgtcctcagcctggggagagcctgagccggccaggacaggcagctcttccatgtggctccttgcggtccccacagtagtcgctttgtggggcagggagaggcgacgggcatcccgccagtctcctggatacttcaggacatgggtaggcccacggtggtgttcccacgcagttttgggatgtgcagtcacctgaaggcagctgatgtgaagaagagcacggtgggtggtgtgggcagggtggccaccccgggattacctgtgtgctgcccacatccgcccaggtggggattcgtgctcaggtggcttactggggggtgcggaggagagcaggcttctcaatgcttatggaaacaggagaagacaagcaggaggtgggtttcaggaggcgagtttcggcccaggtcctgttggtgcttgcagcagcttgatcctagagtgtgcctggcagtcagtggtcacacgctgcaacgggggaacatgagcctccagcactttttttattttgagacagggtctcactctgatgcccaggctggagtacttggtgccaccatagctcactgcagcctctagctcttggttgggctcaagcaatcctcccgccttggccacctgagtaactggaattacaggcatgtgccactgcgcgattaaaaaaatttttttttggccaggcacggtggctcacgcctgtaatgccagcactttgggaggctgagatggggggatcacttgaggtcaggagttcgagagcagtctggccaacgaggtgaaactctgtctctactaaaaaatacaaaaattagccaggcgtggtagcgcacgcctgtaatcccagctactcgggaggctgaggtgggagaattgcttcgactcaggaggcggaagttgtagggagccaagatcaccattgcactccagcctaggcaacagagcgagacttcatctcaaaaacaaaacaaaacaaaacaaaacaaacaatttttttttttttttttttttttttagagatagggcctcactttgttgcccaggctggtctcgaactcgtggacttagatgatcctcccacctcgagctcccaaagtgctgggattacaggcgtgagccaccgctcctggctgaaattcttctttcaaccaaggaagatgtgtaatgagctttgtgaccccagaaaggcatgtgcagagcgtggctgagagtggcaggtgtgggtcccaggcgaaagaggtcgactaaagaggagctgttcatcatggggtgggcactcaggaagagccagagattcctgggcttggagcaccagcatctcagcatgttccgacagaaggggcctcaaggtgactccctttgggaagctttggcttgaacccacttttcctccagcagcgcagagcttctcgctcgctggtgtgcaccggcgcgctgtccagcagggggcgccactcccagggccgcttccccgcgggagccctcccttcctggcatatcgtgggagcagcgttccctcccacacacctgacttagaacccccagagttctcacatgcgagtcgcacttgtctgctgtattctgagtatattgtgcttgcaaatcaatcctaagtgaattctattttgaattcaaccaatgaatgtaacgaaacctcaatcactgaacagagaaagcaagtttgagttatgtaaaactaaatgatgagttattttactttatttttaattttattattttttttttagatggagtctccctctgtcgcccaggctggagtgcagtggcgcgatctcggctcattgcaacctctgcctcccgggttcaagtgattctcctgcctcagcctcccgagtagctgggattacaggtgcccacaaccatgctcagctaatttttgtgtttagagatggggtttctccatgttggtctggctggtctcgaagtcctgacctcaggtgatccacccacctcggcctcacaaattgctgggattacaggcgtgagccgccatgcctggcatgatgaattattttaaaataaggcttattgatatctcatttaattcttaactttatgaagaatgcctttttatcttcttttgctgcttacaagttcacacagcatctcaagcctggattactggccaagaatgatgtataatgaccacctcacttacttatctgtaggtgggtatttctaaatgcttatgggtacttacattttaggactcctcaaatattttattattattattattattggaggtggagtctcactcttggctggagagcaagtggcgtgatctccactaactacaacctccgcctcctgggttcaagtgattctcctgcctcagcctcccgagtagctgcgactacaggcatgtgccatcacatccggctaatttttgtaattttagtagagacaaggtttcgccattttggccaggctggcttcgaactcctgacctcgagtgatctgcccacctttgcctcccagagtgctgggattacaggcatgagccaccgcacccacccaggactcctcaaatattttaatattactctggcacatttgattaaatagcactaaatttccctatctatgaagaaactatttgctcaaataaaggggtaaatttcagcccaggcactctgagaattatcaatggttttgagacaggatttaatgtatcatattggatacttttcattcattgaaaaactaggtctttattttctgagggttagcctagaattttttttttttttttgatatggagttttgttcttcttgcctagactggagtgcaatggcatgatctcggctcactgcaacctccacctcccgggttcaagcgattctcctgtctcagcctcccgagtagctgggattacagaagcccgccaccacacccggctaatttttgtatttttagtagagacggggtttcattgtgttggtcaggccggtcttgaactcctgaccttaggtgatctgcccaccttggccccccaaagtgctgggattacaggtgtgagccaccacgcccaggttttttttttttttttttttgagacagggtctcactgtcccgcacactggagtgcagtggttcgatcatggctcactgcagcctcaaccttctgggctcaagaaatccccctgccttagcctcccaaagtactgggattacaggcatgagccaccacgcttggccagcatagaatttttagaaaccttttttttttttttttttttttttgagatggagtctcactctgtcacccaggctggagtgcagtggcgtgatctcggctcactgcaagctccgcctcaccagttcacgccattctcctgtctcagcctcctgagtagctgggactacaggcgcccgccaccatccccagctaatttttgtatttttttggtagagacagggtttcaccgtgttagctaggatggtctcgatctcctgacctcgtgatccacccgcctcggcctcccaaagtgctgggattacaggcgtgagccaccgcacccggccagaaacttttcttatagctttattgaagtataaagtctccacataacattatgtctacataatttggaggttattggtaagtttcacattaattgcacaatttgatgagttttttttttttttttgagatggagtctcaccttatcaccaggctggagcgcagtgatgcgatctcagctcattgcaacctccgcctcctggttcaagtgattcttctgcctcggcctcccaaagtgttgggattacaggcatgagccaccgagcctcgccaatgagttttaacatatatatacacagtcaaaccatccccacaatcaagaaaatgaacagatccatcaccccccaaagtttcctcctgactttttgtaatcaatccctcctcctccatctctgctgtgtttcccttagatgagcccaggagttcaagaccagatggcatctctctcattcctgatattgattttatcttcttcctttatttttttcttgatcagtctggctagcggtttatccattttattgacgttctcaaagaaccagcttttggtttcattgatctttctccattgtttttctctttttcgtttcttttttttttttttttaaggaggggtcctgcggccgggtgcggtggctcacacctgtaatcccagcactttgaaagcccgaggcgggaggatcacgaggtcaggagattgagaccatcctggctacacggtgaaaccccgtctctactaaaaatacaaaaaattgccgggcgtggtgtcacgcacctgtagtcccagctagtcaggaggctgaggcagaagaatcgcttgaaccggggaggtggaggttgcagtgagctgagattgcgccactgcactctggcctgggtgacagagcgagactccatcttgaaaaaaaaaaaaaagatggggtcttgctatgttactgagggagatcttgaactcctgagctcaagcaatctttctatctcagcttcctgagcctgggattataggcacatgccagagtgcccagctctctgttttctcttccattgaaacgtctaatttcttgtctttcccatctttggcttgggaaaaatttgctcttttctttgtagtttcttacgtctcatgtctggtccacctaacaggcttatttctattaattaacccagtggagtctatggtaagcatcagtatcttggagttcagttatgggagactcattgcctccagactgattagctctggaggacaggctaaatcaaatttctactctggcaatagaaagagctaccaggttcctggaccacaatagctgcactgagcatggtccttccctctggcctggccaggaagtcagaaaccattctgtcatttccttgtcattagtaatagagtaattggtaatatatagtcactaaagatatcccttactctattttagcaagagctaggaaattattttttaattagcatccttatttaattaaattcattaaaagatatgagtacctaccataaatgcctggtcctttgttagatatcaggcttacaagagatgaattcatgtcctttacatacatctgcaatttatcatctatcctacaattgcttcacagtttactttatttttggatgatgcaatttaggttcattacaaatccattagctatagaattacagagctgagagagattctggaagtcttaatttagagatgagaaagccgaggcccagagaagttacggagtttgccagaggccacacaggcaatgagcagtagctccagccggaacccgaatccaacctatgtgaatgatctcaggtacaggggcacaaataagaggcacaggctgtgcacaggcatttgcagaaatacatatatatatatattttcttgagacagtctcactctgtcatccaggctggagtagagtggcatgatcacggctcactgcagcctcgacctcctgggatcaggtaatcctctcgcctcagtctcctgagtagctgagtagctgggactacagcccggcctggaaacactttttacatggcacaataaaaccagaataggccgggggcggtggctcacgcctgtaatcccagcactttgggaagccgaggcaggcggatcacgaggtcaggagatcgagactatcctggctaacacggtgaaaccccgtctctactaaaaatacaaaaaatacaaaaaatttgccggtcactgtggcgggtgcctgtagtcccagctacttgggaggctgaggcaggagaatggcgtgaacctgggaggcagagtttgcagtgagcggagatcgcaccactgcactccagcctgggcaacagagtgaaactctgtctcgaaaaaaaaagaaaaaaaaaaaaaactagaatgatactctgtgtgctttttatgtgaggcttattacgatttttaaaattttagtattcctcttttaccactcctaattttcatctgttctacaaacacttataatattccaactccaacacgacctagtttacagtttttactgaggtgggagcagcatcgtttacttcctctccatggccactgtcccgagtatggcgtgcgcgccacaaagttcaggaagcgtggctgacctctgagaccccgaccctcttcctcacgccttgcatttggtgccagcagcagtggtagaagcagggctagggaggccagcgccagctgccgctttctcctgcagggggagggcgagctctgtgggagcctgcagcctcctcaccgcgttgttaggcgggtcttggcggggttgggtgaactgtcttggttgcacgacctgctcggggttattgaaatggctagtggtgaataactccctctctgaaatacactttttcccactctgtgaaacccacctcctctggatgctggagcaaggatgccacatcaaactctgcctgctgcctgctctaattcggtcctggagtcccaaggagctaccagtgcagtgagtgtagctcaggatgacatgttactcagcaatgggcccagtgtctgacacgcatagaagccaacactatggcaccagctttccaagaaagaaaaaagctttattgcgagcggactgcaaggagatgggagacaacgcttaattctgcctccctgagctgggggtgggtccagcttttatggcattcctagctggtcccaggtgatgccaatgtagctggctggccaggctgctggtaaggatgaggaggttaaagtgtttcccattgcccacgcctgggcaattctggctctgcgtcagctaattaacttaagcactggttaattggcttgagctggtcccttggttacaataatgccagggctgaggtttgctccctgcagctctgagctgcctaaacctttggctcttcttttgatggcttctaagacacccaaataccaaatgctcaaatttgtttttttaattatccaactttttgttttcgacagagacggggtctctgtcgcccaggctggaagtgcagtggcgcaatctcagctcactgcaacctccacctcctgggttcaagcagttctcctgcctcagcctcctgagtagcaggcattacaggcatgtgccaccacgcccggctaattttgtatttttaatagagacagggtttcaccatgttggccaggctggtctcgaattcttgacctcaggtgatccgcccaccttggtctcccaaagtgctgggattacaggcatgagccactgcgcctggccaactttttttctttaaagtgacgtgtcaattcaaatttttctcagccaaacagtattcatttgatgttgtatattggaagtttttcaaattgcaatactcagcctttttattgtgaagtggagtatattttttcaaacgtaaagacggatcttgggccgggtgcggtggctcacccctgtaatcccagcactttgtgaggcctaggtgggcggatcacgaggtccagagatggagaccatcctggctaacatggtgaaatcctgtctctactaaaaatacaaaaaattagccaggcgtggtggcacatgcctgtagtcccagctactcaggaggctgagtcaggagaatgatgtgaacctgggaggcggaggttgcaatgagcggagatcacgccattgcactccagtttgggtgacagagcgaaactccgtctcaaaaacaaaaacaaaaacaaacaaacaaaaaagaccaggcgcggtggttcatgcctgtaatcccagcactttgggaggccaaggcgggcagatcacctgaggtcgggagttcgagaccagcctggccaagatggtgaaaccccatctctactaaaaatacaaaattagctgggcgtggtggcgcatgcctgtaatcccagctactcgggaggctgaaaggagaatcgcttgaacccgggaggtggaggttgtggtgagctgagatcgcactattgcactccagcctgggcaacaagagccataaagatggcagaaaagactgaatgtattaccatatttgaaaagaaaaaaaggctgggcgaggtggctcacgcctgtaattccaacactttgggaggccgaggcgggcggatcacgaggtcaggagatcgagaccatcctggctaacacagtgaaaccctgtctctaataaaaatacaaaaaattagccacgcgtggtggcgggcgcctgtagttccagctattcgggaggctgaggcaggagaatggtgtgaaaccgggaggcagagcttgcagtgagccgagactgcgccactgcactccagcctgggcaagagagcaagactccatctcaaaaaaaaaaaaaaagaaaaaaaagaaaaaaaagcagatcaggaagacagcatggaaacatttataaccatgaacatttcagtcctgagttgtagttttaaaaatgtttttataaccataaaaaattcagtctggagttgtaaatttagtttaaaaagtaaggtttttttgggggggaggggcaaggtctcactctgccacctggaatgcacaaccctagctcactgcagccttggttacccaggctcaaacgatcctcccacctcagcctcctgagtagcttggattacaggcgtgagctgtcacagccagctaattttaaaatttacttgtagagacagggttctgccatgttgcccaggctggtctcaaactcctggcctcaagcaatcctccggcctaggcctcccaaagtgctggaattacaggcataagccactgtgcctggtttaaaaaataagtttttattcctaactaaatgagagttttctgacattttccctctagacttaggtgttcattaactctggcctatattacatcattctttaagagggaaaacaagtgaaaaagctgagacttcctttgtagtaagagacatcaggggagcggttgttgtgaagagtggtgatgagacagtcactgtctgacagagccgcccgcagagtcgttaccttcatttcctggggctgcacagtgccagcttctcaaacaggtattataatactaacacaggcttccatcacatggctttttttttaaagtatttttaaaaactttttattgggaaaagttaaaatgtatgcagagtgaattctgtaatgcacttctagacgtccaccccctaccctctacacaattaccgatctcatcccatctagagactccgtccccccaatctgttttgactggctagtatttgctggtgtatcttaaagtacatcctaggtatcatttcacacctacataattgcgcctgcatttctttcttttttctttttgagacagagtctctgtcgcccaggctggagtgcaatggcacgatctcggctcactgcaacctccgcctcctgggttcaagcaattcttatgcctcagcctcccaagtagctgtgattacaggtgcgtgccaccacgcctggctagtttttgtatttttagtagagacacggtttcaccatgttggccaggctggtcttgaacccctgacctcagatgatccactgtgcccggcctgcacctccatttctaaaaccaaagaaattttctttaataactacaataccactattgtggtggtgatcacctaataagattaacacttcaacatcacttaacacccagtccacgttcacatttctctgtacgtaccagaaatgcctcttggtggctggtttgtctgaagggtggaagcagggtccgtgctcagagctggctgttgagcaggtgctgtgcttgctccaaggcccgtgtgcagcgaggcctgatgctggcgcccgtcagacggttcctaacagcacagacgtccaggattgtgtctgccaagcactggcactgtgtgtctgcaggtctgttctctagcctctgtgttcagggagtgaagagaacgtgtgctaaccaccgccgcatccccgacggcaacgcacgcccagcacaggtgaaggagctctctgaagccacgctgtggtccgagtcccgattctgaagcgggtcagattttgaatcctggccaaccagttaactagttggtttgttagccaggtagttatcctctagtacaaactacttatcctgtctgggcatccatttcttcagctgtgaaatggggtgatggtatgggctcacgggttattgtgcagataaaaatgaagcagactacggcctggcaccccggaactcgggatccgttagcttgacagagacaactcccttgagggtggcaggaagcacaccctccaaagcctctggttggggtgcgtgtacccctgggatacagtgacaatcaagaagaaacaccatgccttctcctagagtctcatctgaggctaacttagagcacgttgtttaaaatgacaccttcagctgcctgtgagccacttcctctcctcccagcctttgtcgttactctgcagcacagctgagcactgcattaagtcagagcagcacgaatgcgtaggctttgggacaaaaagcctctgggattccttcctgaactggccctgcccactcccgtggctctctgtgcatacctcttgcccattggcaccgccctccaaatgctcctttcaacagatcctcctggccccgtgctcctcgcccacggggaagcccaggtgacattctctagctccacctacaggctgccttcgggacaagacctggttgtttccaaaaccccgagggattcagtgtgtgagtgagttctgggatagcaaatgcaattattttttgttttctttttgagacagggtctcgttctgtcgcccatgctggaatgcagtggtgtgatcttggctcactgcagtctcgacctaagctcaaacaatcctcaagcatcagcctccccagtagctgggattacaggcgcacaccgctacgcctggataatttttgttattttttgtagagatggggtttcgccatgttgcccaggctgatctcaaactcctgggttcaagcgatctgcccgcctcagcctcccaaagtgcaggcgtgagccactgggcccaacctaccctggtaatttgccaaaggaagccttaagtagtaaagggagaagaggaatggcccagcctttgtggggaagccctcctgggtcagacacatcaatctctgcttccgggggtgaggtggggggtgggggtggggagggcagctcccatccgtcctcacctccctttggaggagagttcaggttctgggggttcaagtcctagccccagtgcttgctaactgcgacatctgtagcgtgttactgcctctcagcctgtttcctgttctgaaagtcagggcctgtactgatgcctcactaggttctaaggtggactaaatgcactaagatgcgtgacacagggctggagcctggtgccagtgcagtggatgtgaaggctgtgatagggcaggcctgggttctttgtatcattagaaattttccagctggggtcctggcatccgcatgtcctggatgcttgttagacatacaagttcttgggctccttcctacagcagtgcaatcagaacactggggcccagctggctgttagggccttccaggtgattctaatgcactctcaagcctgagcagctgggcagatggataattttaaaggtagggcctttctgtaccacagcagattcatcttctggaggcagaagagaacaaaatacgttcgcaggaaaaatgtgattcctgtgtcagaaccaaaccctctgaatctcacacgacctgacgctgacttccactgatgctgtgtaatgctttcctgcaaacttctcacacagcccaacaaccctgaggctgttggaggaagccatgacaggttttggttgtcttacaaaagaaactgaggctcagagagatctccgtcatctgttggacatctaccatgggccagacctaatgaggctaaatgccagagacacagatgataaacaggatggtctcaagaggacaggacacccagggtgcagccaccacccccattccacagctgctctcctacccacctgcagagtgccagatttcaaactggactcacttttacccccatgcttgctgctttagaatctttttagcgcacaatttagggatcttggtaattgtcttagatggagacaaatattatgcagtatgcatttgatactagcctaactagaatcaattggctttttttttcaattggcttattatgtactttgccttgtgattatttcctgatgcaatattctcctacagcttataatttcaactactatgtcattgaatgctaccttatttctaaaggacttcatagtttaaatctttctcttatttatcctcataataactgtaagttagagcttacataattaacatctccattttccaaataagaaaacaagaggctcagagaggccacaagataagtagcaggatcaagtttaataaacgtttattgagcagtagaatacaagtgagtgcctggatcctgatcaccaagtcctgtacaactgaggtaattatttcacaatgatgggtggctcagtgagattctgattgcatgcgctgcatgacaaattatctactcagagtatgcctgacacgccggaggggctgagggggaacacactgaaagcagtaccaggtagcagtgcatctcacagatccatttattcatgccatgaagtaaacggtacttatacaagtgtacagtgacgttccacgctccccatctaacacggcttgctgaaatttacaggcagactgacgttttctttcacatgtactccaagtaaatctggttagtgatgaccaggagcaggcgctgaagcttttgaaagagatgcatatataaatatgatttaagaaggaaggaacaagttggatgtaatttattaaacaagtatcaaaagaagttgatcaacagtccaaaaagataaatgacacctttcaatactattgaaaagtaggattatttctatatgaaacacccagagtgcttaagggttcatgtaatgacagcagacaggcagtggtcacccacagcgcaaagagagaggcagggaaacacctcctcctcaaactcatgtagccagtcctgggtttgtgtaacattcaaatggctacagtttcattgtcactctggcataaatttataaggcgctttctttcaaaatacattaaaggccaggcgcagtggctcacgcctgtaatcccaacactttgggaggccaaggcaggtggatcacctgaggtaggagtttgaaaccagccggccaaccccatctctactaaaaatacaaaaaattagccgggtatggtggcgggcacctgtaatcccagctacttgggaggctaaggcaggagaattgcttgaacctggaaggcggaggttgcagtgagccaagattgtgccactgcactccagcctgggcaacacagcgagactctgtctcaaaaaaaaaaaaacccaaaaaacaaaaccaaaccattaaaaacacatcattacgggtaggctgaggcgggtggatcacaaggtcaggagatccagaccatcctggctatgtgaaaccctatctctactaaaaatacaaaacattagccaggcgtggcggcaggtgcctgtagtcccagctactcagaaggctgaggcaggagaacggcatgaacctgggaggcggagcttgcagtgagctgagatcgcagcactgcagtccagcctgggcgacagagcgaggctccgtctcaaaaaacaataaacaaaataaaacgacatcattagggaacttctaggacagcatgcttgcacagctcacttgtgcttccctattggtgatgatatcgactacctctaattaatccattcctctattactcctggaagttttacttgatccacttgactataaaaagcagaaattcagaattctctttcccagcaggcatagcaaacttcaagctgtgaagcatttcaactgcaccttacatatatactgaactgtgtttcgatttcaattgagaacaacgatataccttgtcctgaaaagacatgatgctgttttccattcccaaccattttcagaagcaaaaatcttacctttcaaagccttacttcttttatctaaaataaaaggaaggaaaaaaaagcagtcatatcaatgctttacaaaaatgcctttgtcaaaattaacatttagctgaaggcattgtagcttaggtaaagcaattcaggaagctttcagaaaatgtcttatagccaagaaatggtaaaattcctaccaaagatgttctatgaacagctaacagccctttcaaatttgcagggctccttaccttctacaatgtcctaaactttagtcttgcagcataaagttttctcttttctctttgtaatcaatggcttagtaacatgtgattgggccacactgctctgctctactgagaaccaagtggttattcctcccctccaaatttttttacaaacaaatttcaaatattcagaacagttgaaaaggtgcaatgaaataccacataccatgaacccataccttaaatattttagccttcatctcttaaaacgaatgtaataccactttcacacctaagaaaactcacaattctgatattaaagtcttgttcaaagttccccaattgggccaggtgttgtggctcacgcttgttaattccagcactttgggaagccaagattggaggactgcttgagcccaggagttcaagaccagcctgggtaacatggcaaaaccccatctctacaaaaaaaaaaagtacaaaaaaaaaattagctaggtgtggtggtgttgggcatagtgacgggcacctgtggtcctagctacttggcaggctgaggtgggagaatcacctgaaatcacctgagcctaggaggtggaggctgcagtgaaccatgatcgtgccattgcactccagcctgggcgtcagagtgagagactgtctccaaaaaaaaaaaaaaaaaaaagaaaagaaaagaaaaaaaaaattccccactgtccccaaatgtcttttatagctgacatgtgctccctgtattttttacgaaggactgtaggtagctctaatgttcatacctagttagaacccatagttcctttacaatgtgaattgtgattctttttgaaaataattttcttcctgacctcagaaaaatcaaacataaggaaacgtaccagcagcccggattttataaacgatgaagcccatcagccccattcctatccaaatctcctggtaaactttggtgtagtagggcttcatggggatccatatgtttttaataatactttgaagcatctgaaaatgaacacagtgattaaaaattagaatgatgattgctttaaacctaactggtaaaagattttaatttgttaagttcaaccccatttcccatgactgctagggagcctcgcctgtgtcagatgtcagacccgttctgcactcacaggggactcacacctcttttttttttaaggtggagtctcactctgtcacccaggctggagtgcagtggcacaatcttggctcactgcaacctctgactcccaggttcaagtgattctcctgcctcagcctcccgagtagctgggactacagatgcgtgccaccacgcctggctaatttttgtatttttagtagagagagggttttgccatgttggccaggctggtctcgaactcctgagtgcaggcgatctgccttgctttggcctcccaaagtgctgagattataggtgtgagccactgtgcctggccattttttttttttttttttaaagcagagatggggttttaccacattggtcaggctggtctcaaactcctgacctcaagtgatctgcccaccttggcctcccaaagtgctaggattacggtgtgagccacagggcccggcctgggactcatgctttccacagctcttccaactcaacccatccccagggccccctcctcccacctttggccatcctagccacttctccttccttacatcacagagctcatccagcacctctcccaccctgatgccatgccctgaactgcacatgactctaatgtctaaatcgaaaaattagtatcttctcatcgtcatgtaatgaatgtcgcattcgaagctgaaaaagaatatggccagggcatggtgatttccttgtgaaactaatgccaggctcagcacactctgatcagctgtatctccatcttgaagtctattgctaaatacaaaacagatgacataagacaacgaggtcacttcataataactgccaattaagatagaacttatttaatcaataaaggtagttacttaatgaattactgaatttgattgggaaaagccattaaattccaaacttacagtttgcttgtatgtgcaggtctcaaaataatgctttttgttacttttacaatttactctctactatagaccgcaaattagatgccctcattttcattttaatatgctttttaacatctgaagtggtccattaaactacagtcaaatagctgtcaggagtgactagatctaagcacttctcatttcacttggaaactgctttggttgggtgtggtggctcatgcctgtaatcccagcgctttgggaggctgatgtgggagggtcacttgagtccaggagctcgagactaatttgggtaacatagggagaccccgtctctacaaaacataaaaaattaaccaggtgtggtggtgcttgcctggctaattttttatgttagtcacagctattggaagactgaggtgggaagactgcttgagcttgggtggttgaagatgcagtaagccatgatcacaccactgcactgcagcctgggtgacaaagtgagactctgtctcaaaaaagaaagaaagaactgcgcgttggctgcggctgtaatgctgcctccacccctccctccctccacccactcactgctcctttcacatcactgctcaggatccaaagaatccgaatgctcggcagtgtgctccctttcccacactgcgcagctgtgtgtgtcagctttaccgcactgaatccttcacaagcccaacctagtcaaaggtcaaatggcggccctcaaatcactgaaacccggatcgtgtggtcatttattcacttggcaaatgtgcactgagcatgtactaggtgccagacattgttttaggagctgagaaacaataaagggtcaggatatctgggagaggaatcctcggcattggcagagactccgaggtcagaatgaactcggagagctggaaggaatagggaggccacagtgccagattcaaatcctggctgtcacttactagctaacttaaaccgcttaagttttctcatctgtaaaacagggataaaaacaggatccacctcaaggggttgttatggagaataacatagaataactctatgtcaaatgttgagtgtctggtactgtatattaaatgcttgttacataaaataccatggctggactatgggaaggaagatgggccatgtcatttaagggccttggaggctagcatagaatttagcttttattctaaaactgttctctaaatttaacaactttttttttttttgctttagggtttttttgtttcccgttttgacaatatgaagaaaattcagtttagaatctggaactggcctggatgggattcgagggcagctggtgggggctgcagagccccttcgattcctcccccaccgtgggagctaagctactggacagaggagcaccaacagggcaccgaaccaggaactaagttagtgtcttgagtcaggcaagaatggggaggccaggccggagctacagcagggactgccctgattgtggttagttctgtctctagccctttaacagcattttaaaagtgcttttcgtacttacttcctacactgcttcccactcctataaagtgggtacttggagaaagctcctataaagcgggtactcggatcccgcagcaggttagcaggactgcactcacaccaaatctgtacgtcatgctcctgatgacgagaacctacctccaacacctgctttcctgctcttccctatgagaggacttatttaggcaaggatggtcgtgagggtggcctgaggtctgaccttgcaggatgcgactgtgtccttctcctggaacaccttgcagatagtccgccctcaaatttcctgtcctcaagctactcgaatgctctgacagtgtgaggttccaagaaacgaacagccctgctttgggaatatgtcacagatgatccaaacaagacccagaggaggtttctggaagccccagactaggagttcagaggcatggagtgaatcccttgtctctcagcaacgactgggaaggaagcattctacaggaccgatgggtttggaagcctgggaatcctgggctccaacaccagctctgcctggtcagctctcaactgtgggcaagtccctttagctgttgtttcagaggtttttttttttctcttttttgagacggagtctcgctctgtcacccaggctggagtgcagtggcggatctcggctcattgcaagctccgcctcccgggttcacaccattctcctgcctcagcctcccgagtagctgggactacaggtgcccgccaccacgcctggctaattttttgtatttttagtagagacttggtttcactgtgttagtcaggatggtctcgatctcctgaccttgtgttctgcccgcctcggcctcccaaagtgcagggattacaggcgtgggccaccaggctcaacccagaggtttctttttctgtgaaacagggatacctccacctgcccccagagggctgtcaatgcaattcaaagaggaaaccaaggccgggagcggtagctcacgcctgtaattccagcactttgggggtccaaggcagggagatcaagaggtcaggagatcaagaccatcctggctaacacggtgaaaccccgtctctactaaaaatacaaaaaattagccgggcgtggtggcgggcgcctgtagtcccagctactcggaaggccgaggcaggagaatggcgtgaacccgggaggcggagcttgcagtgagccaagattgcaccactgcactccagcctgggtgacagagcgagactccatctcaaaaacaaaaacaaaggagaaacctaaaggacccagcctagtgcctagtgcctggtacggaataaaaatccagagaatggactgggcacggtggcttacgcctataatcccagcatctcgggaggccaaggtgggcggatcacttaaggtcagtagtttgagaccagcctggctaacatggcgaaaccatctctactaaaaatacaaaaactagctgggcatggtggtgggcgcctgtaatcccagctactcgggaggctgaggcaggagaatcgcttgaacccgggaggcggagcttgcagtgagccaagatcgtgccactgcactccagcctgggcaacaagacactccccctttatcttaaaaaaaaaaaaaaaaaaagaattcagtgactgatcacagcagtaacagaattgatacaaatatccagttcatggctataattaatactaagccactgggactctaacaagaaggaaggcttaaaaagacgccctcatttaggccaggtaggggctttggacagaacaaggtaagatgagggtctataaggaaaagggcaaagtaaactgggagggtacaatgactacggtaagaagggactaaagaaactgagtcatgctgacattgtgctccgggcccaggcaccctggtatggtctccttacaaaattacccttagtccccagtgcaacaggggcctgctattcagtagcttgcaaatacctttcccttcctttccccttgacttcagttgccatatttgcctggacaagtgacatgttcccaatacataataaaacgagggccccccctttttttttttagacagagtttcagttggtcatcaggctggagtgcaatggtgcgatcgcggctcactgcaacctccgcctcccgggtgcaagcgattctcctgcctcagcctcccgagtagctgggactacaagaggccgccaccacacccagctaatttttgtatttttagtagaaacggggtttcaccatgttggccaggatggtctcggtctcttaacctcgtgatccgcccgcctcagcctcccaaagggctgggattacaggcgtgaaccaccgcgtccggcccctactttttttttttttttgagacagtctcgctttgtcacccaggctggaatgcagtgacgcgatctcggctcactgcaacctccgcctccagggttcaagcgattgtcctgcctcagcctcctgagtagctgggaagctgggactacaggcgcgtgccaccacactgggctaattttttgtatttttggtaaagacggggtttcaccgtgttagtcaggatggtctcgatctcttgacctcgtgatccgcccgcctcggcctcccaaagtgctgggattacaggcgtgagccaccgcgcccagctacatattcccaacacataataaaacgacagcccctacttttttttttttttttttttttaagacggagtttcactcggtcatcaggctggaatgcaatggcgcgatctcggctcactgcaacctccgcctaccgagtgcaagcgattctcctgcctcagcctcccgagtagctgggactacaggtgcctgccaccacacccagctaatttttgtatttttagtagagacggcgtttcaccatgttggtaaggatggtctcgatctcttgacctcgtgatccgcccgcctcagcctcccaaagggctgggattacaggcgtgaaccaccgcgcccggccggcccctttcttgagtccattctgcccaggcacatttcctagctgtgtgtgtcagttttacagcaccagaccttttaaaaatccatcttattcataggccaaacgtgtgtctactgtatccacttaagtctgcaaagttttggcacattacattaagggcgaactattacctgacactggaaatgggaaatgtctgacccgcgagttccatacaatttcattcagcaccgtatgatctcttttcagcttccctgttgcctcacccaagttgtcatgtacagcataacgtggagggcagtgtggcgcaaggaaacttgagttataaaggagagaagggactggatgtggagtcagagttcttggcttggactctggcttctctaactctgcgtagcctctgggttaggcagctgaacctctcaaggccaaggtacgctccctgtcaaaaccgtgggagaattcaggtgcactgagcgcgttaaggccaaggagggaaacgcggcgcaggcctaggcgatgcttccctctggcaaccgaccctggcctacctcccttcagagaagggaaagccgggcagaaaagcaggcgcgtgccggcggaggggtggaaccccaagatcagctggggccaaggcggcttctcgccctcccgcccccgccgtctcgcacctcgggagccaggtccaggtccccgtactcaccttggcgcaggacagacggctcagaacgcaccacaaatctgcagccaactcggaaaggtcaccgagcgcgcaggcgcgcgcaggggatgccgggaaggcggaagcagcagagacgccgcaaggccagagtgcctccccagcggcgcctccgcaccacagcgcccccggcggccgcctggtgtcgcaggcaagaaggggcggggagagggtgcgttaggggtgtgcccgcgtgtgtcactgtgggctggctaatcctccacatcttcccacgactgatgggtttcctgggacgcgggaccttcaacgctgaaactaggaaagttctagacataccgggagggttggttaacctaagaaaagggaccctctttactgtgacgttaaagactaagtcaagtctcccatttcagtggtgtgtcttgtccctttctattgttaattatttagctctgcatgtataaaatatatatatttggagacggagtctcactctgtcgcccacgctgcagtgcagtggcgcgatctcggctcactgcaacctccgcctcccgggttcaagcggttctcgtgcctcagcttcctgaatagctgggattacaggcgctggtcaccaagcccagctagtttttgtatttttagcaaagacggggtttcaccatgttggccaggctggtcttgaactcctgacctcaggtgatccacctgcctcagcctcccaaagtgctgggattacaggcttgagccaccgcgcccggcctgctctgcatatttttatgtctgtattctgtgcatattcttctcagcagataatataaaacttccacaggggctccagacactgggcttaatagtcttaaaaatatatatatatatatatattttttttttcagaaatattttccagtagagaactagaaatcataaaagaaaaaaatttagcgagcggatcacctgaggtcaggagttcaagaccagcctggccgacatggcgaaaccccatctctactaaaaatacaaaaattagccgggcttggtggtgggcgcctgtaatcccaactgctcaggaagctggggcaggagaatcacttgaacccggagggcaggggttgcagtgagccgagatctttgcactccagcctgggcgacaagagtgaaacgccatctcaaaaaaaaaaaaaaaaaaaaaaaagccaaataaaaattggatggaggctgggcgcagtggctcagcactttgggaggcctgtaatctgtaatcttagcactttgggaggccaaagcaggcaaactgcttgagttcaggagtttgagaccagcctggctaacatggtgaaaccccttctctactaaaaatacaaaaattagctgggtgtggtggtggtgcgcacctgtaattccaggtacttgggaggctgaggcaggagaatcgcttgaaccctggaggtggaggctgcagtgagctgagatggcgccactgtattccagcttgggcgacagagcgagactctgtctcaaacaaacaaaacaaaaaattggatggatttggcagattagacagttaaagaataaactgcaagatcgaagaagccattcagaaaataagagggatacagcaggaaagataccaatcatatgggtaattggtatcttagaaggaaattaaagaggtgaggcagaaatatctgaagagctaatggctgagaattttccaaaagtgatgagaaaaaaatcatgccaaagattcaaaaagccttacagaggccaggcgcggtggcttacgcctgtaatcccagcactttaggaggccaaggcgggcggatcaccacaccatcctggctaacacggtgaaaccccgtctctaccaaaaatacaaaaaaattagctgggtgtggtggtgggtgcctgtagtcccagctactccggaggctgagtgagagaatggcgtgagcccgggaggcggagcttgcagtgagcagagatggcgccactgcactccagccagggaaacagagcaagactccgtctcaaaaacaaaaacaaaaaacaaaaaacaaacaaaaagccttacagaaaccaagcaggcagataaataaaaataaatcaataccttgaaatctcacaataaagccatagaaaagataaagataaaatctcaaagaaagtaaccaccaatcaagaattctatacacagggaattctatacacagggaaattggcattcagaaaagaaggtaaaataaagacagttaaggacaaactaagaggaaatcgtgctaggcatggtggctcatgcttgtaatcccagcactttgggaggactgcttgagcccagaattttgagaccagcctggccaatgtattaagatcccatctttaaaggaaaaaaaaaaagaggaaattattaggttttgaagggaaggcaagggttaaagacagacaagacagacacacacacacagagggagggggggaggggagaggggagagagatggtggcttcaacagcaacacaggtttattgccagcaaaaacccgtggagcggataaccagtttagtgcccgagctcactgccgcttccaggctggggtaattataggtctgggctggatgggtctgggcagtatggcttgctgcctggcaggatgtgataaggatgttcccgcagtcaggcagttgggcaggatgtttcttatggtcagagcccccatggaatgtttcactccgaccagggtctgtgaaatggtggggggtttataaaatggtgcagctaggactgaaataatcacaagcagatccacagtaaaataaatgttcattattcaggcacaaggaaaacgagctcagatgtgtcaagataaaataataaaaggctcaagatccagttaaaatcattttttttcttttttgagatggagtcttgctgtgtcgcccaggctggagtgcagtggtgcgatctttgaaaatgtaaaagtgttattcctctcacacacacacacacacacacacacacacacaatgttttttggaaaacatagtgacgttttagaaaaatacactgtttaacatcaaacgggtttatcattttaaaataaataagtaaaaacatttctcagttgtaatccctgatagacataacccacataaacaaaatctctttagggtcctcagcaacttttaagagtgtaaaggggttctgagacagaaccaggtttgagaaccactgtcctatagtaaaaatgttttagagttttagatttataatgacttataacactgctgaggacgagaacaagcatttaggaaaaacttaaggaagaacatcatggagagctgcttcaagacagagcttctgaacttccaactagacttgagatcaatagactttgctatgttgcccaggctggtcttgaactgctggcctcaagtgatcctcccaccttgacctctcaaagtgtcagaattacaggcgtgagccactgtgctcagaccaagagagttttaatgtctttagtttcaaatccaaaacaccctaagaaacgcacatcttaaaaaaaaaaaacaaccaaatgtttcttttttttttttttttttttttgagatagagtcttgctctgtcgcccaggctggagcacagtggcgtgatcttggctcactgcaagctctgcctcccgggttcacgccattctcctgcctcagcctcccaagtagctgggactacaggcgcccgccaccacgccaggctaattttttgtatttttagtagagatggtttttcaccgagttagccaggatggtgtcgatctcctgacctcgtgatccgcccgccttagccccccaaagtgctgggattaccggtgtgagccactgcgcccggccaaaaaaacctaaatgtttaaggaaagggccactccagcagatttattcaaagtgcagaatgttgcatcttgtggtaggaaggctggagaagacagcaagctacttcgagcacagcttcctctgctttgaggagagtgctgctgaatggcaccaacaccatttgtaactgctctcagctgttagtttcccctttttggtggacgctcaaatgctcagtgaatgcaaatatgcaaaaccttcccaaaataccatggctcactaggggttcagtggccttcccatgtgttctggcctagatgtgacaagtccatgaagatctatctgatgtcaagctgtttcttgtttcttttttcttttttgagacagagtcttgctctgccgcccaggctggagtgcagtggtgcgatcttggctcactgcaacctgcacctcctgggttcgagcgattctcctgcctcagcctcccgagtagctgggattacaggtgcgcgccactacacccagctaatttttgtatttttagtagagatggggtttcatcatgttggtcaggctggtcttgaactcctgacctcacgatctgcccacctcagcctcccaaagtgctgggattacagtcgtgagccaccgcgcccagcccaagctgtttcttttaactctgaactttggacagcaatgcaaggtgaacttgaccaagtgagttgggagcaccgagaactactgaatcaaatgaaaggtgctcaaagccattcagtctgtgatgattcagaatgttaactagtgtttggtcaggaaacactatggcaactttccaaattggcaaatttccaaagaagcatcaagagagtatctttggattgcaattaaaaaaaaaatcaaaactcagaaggattagctagtagcccaaaagatcaaagaatatagaaaatgccccccagaaaatgtttttgaaaagcatcttccacttaaaatcgtattcattgtgacatcaacaaaggatgacagcacacggtaacagcaacatcctagaaaaacaggccaggcgcggtggctcacgcctatgatcccagcattttgggaggccgaggcgggcggatcatgaggtcaggagattgagaccttcctagccaacatggtgaaaccccgtctctactaaaatacaaaaaattagccagccatggtggtgcatgcttgtagtcccagctactccggaggatgaggcaggagaattgcttgaacctgggaggcagaggttgcagtgagctatcgcgccactgcactccagcctggtgacagagcaagactccgtctcaaaacaacaacaaaaaacaaaacaaaacaagtgtgagttctggagttgcttcaagtggtttcaatatattttgtaaaattttgaattatgtcctagcctccacatacagtgtgaagttacaatattttccaatcaatgctgaatgacataccatgagtctcaattactttatgattaccttttttcttattttttgaaaaacatgactgggcatggtggttcatgcttgtagtctcaacactttgggaggccaagggctcccaaacagattgcttgagcccaggagcttgagactggcctgggcaacacagcgaaacccctgtctgtactaaaaatataaaaaattagccggtgtggtggtggcgtgagcctgtagttccagctatgcaggaggttgtggtgggagcatcacctgagcccccgaagttgaggctgcagtgagccctgattgcagcacggcactccagcctcagcgacaggagtgagaccctgcctcaaaagaaaaaagaaaagcaagttatttcttcctggcaaagtgtgttgaggcacttttgggaacctgtcgtatttggcagagtcctaatatgaggtctagagctcattatgccaggatttggagccagaactcctggcttagtatgattatgggttcaatttttgagacaccaatagctcaacctacctgcctgatttctgtctacagtgttttcaaaccgccctcttatttgccactgcttgggctttacactgctgattagagccatgctctcgataccgtctctgtatttgttcacatggctctttcctgagagcccacatgggccagatagatcctgccctggccagtgagggggacacaccccaggcaggtggccatgtctctcttctgaccctcccttcccttgcacacgtggctgccttcccgtgcatcctttgttgatttcttcccgcggctccttcttttggggagtttgctagggctctgttctccaccctcactcttctagagctcggccgggaccacctcagcctgtatctttggtccatgtgatcgcctggacctcctgtccgcacctgtttgtgtccagctgtgagtctgacaccgccgcctgagacaccggtttaggaaggaagatgaattcagttatgatccggctgcaaagaacttctcccagatcctcacctcagccatcagggccgcctgccctcccctataaccctgggtggtcctccgtctggcgcattcccccgtatcctgcaggggtctgcctggcgttactttctccgagaccttcctgaccttcttcttgcccctctccccccatattaggtgcaaggatgtcctggtacgtctgacccacgaacgcaaatcccttctctggtttgccttccatctcctcaccctgaggtgctcaagaaacgtatgtagggtcccggtccgctcaaagcgcacaaacctccgaggcagcagcctctaaatagagaggccagggagtgaccggagggcattttcttgtacacacaggggttgccacggaactcccgtgaaacagactcccgggccagccgcggcgctcaagcttcccctgaggtcctagaaaggctcaccctgggctcgctcggggcggcggctcccggcaggcctagcgcggcggggcggggccggcggcacgaggaccaggcagcgcgggcagcacgcgcccgggccggagcccgcccacaagggcgcgcggcgcgttctgattggaaggcctcgagcgggggcggggcttccagggtgcgcttccgccgtcgcctgttcccgccgcggagacccggcagttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtaggacgcgggcggggcggaggcggctggagggcggccgggcgaggcctggcgacgagggcacgggccatccagatccttctcgcgagcccgtgccctctcgcggggctccagggacccctgaccgtccagggcgagtggtcactacacaacccgacgcgcggcccagagcggtgcctgtaaggaagctgagctagaggtttttttttttttttttttttcagttcttaatgtttaacagactagtttttgaggcactcaggttttcaggataacggagcggagggcagaggtcccataggccccttccctcccagagtttcccctgtgagcatctgcgtaaggtgtgggtatttgtgacagtcggcgaacctgcatcgctgcgtcttcgtcacccggaggccatcgttacaggagggttcacgcctcgtactggacgttctgtgggtttggacaaacgcctaacgtcacgcattacagagttcactgacctacagatcttctcggccccactgttcctgcctccctttccctacaccacgtggaaaccactgatttttttactgtctccataattttgcttttccatactgtcatctagttggaatcacacagtatgtgtagcctttttgatgggtttctgtcacttagtattagtatgcatttgggggttcctccatgcctttccatggtttgatagcttctttccttttagcactgattaatattccactgtctggatgtaccacagtttatctccattcacctactgaaggagagcttggttgcttccaagttctccccccaccccccgagatggagtctcactttgttacccaggctggagtggagtggcgccatctcgcctcactgcaatctccccctcctaggttcaagcgattctcctgcctcagcctcccgagtagctgaggctacaggcatatgccaccacgcctggctaatttttgtatttttaatagagacagggtttcaccatgttggccaggctagtctagaactcctgacctcaggtgatctgcccacctcagcctcccaaagtgctgggattacaggcgtgagccactgcgcccggcctgcttccaagttttggcaaggtttttgtgtggacataagttttcaactcattgggtaaataccaaggagtgcaaatgctgaatctttgttaagtttcacagactccctcctcatctcactattctttaagtagctaccatcagttactctgttcacttgatttgggtggaaataaaaagcaagagtatatcctctgtttttagaggaaagacgtagatttggtgagtagaaacacctgctccctcttctcgctctttaaaaaggccctgggagaagtacttccagcttggagtatctccgtcactcttgctcagtccccaagtccagcacgctttacagttgagaaggtggttttgtttttctttttcttggttttttttttttgagacatagtttcgctcttgttgcccaggctggagtgcagtggcgcaatgttggctcaccacaaacctccgcctcctgggttcaagcgattctcctgccttggcctcccgagtagctgggattactggcgtgtgccaccacgcccagcttattttgtatttttagtagagacagcatttcaccttgttggccaggtcggtctgaccttgtggtccacccatgtcggcctcccaaagtgctgggattccaggtgtgagtcaccgtgcctggctttatttttcttttttaaagttactcttgtttgttagtcttgtctgatttgatggataggcccagactctgggtcaagctttcgtgggttgcttcaagcctttgtagagttctttcaagtacacctttgggatctttggtaaatttggttcttagaggcataggggggaccgagagaccccttgtgcaactttggagttgctgtttgtatgtttgcacactttacttccttgagctactctggtaaatgatcctgtgggccgcctcccctacttaatggtccatcacttactccttagttttaacggtgtgaacagcattgctattaaataacccattgtaatattggaagtaaattattattgaccttgtcagaaagtatagatttaagtgccattttaagcactaaggacaagtttttaagatttctagtccttcatggactgagacttttataaaatcaataaaaatgaattttcagagcaatgaaatgaaaaaagacaacatactaatcgcagttaaaaaattattagattcaatctgggtgtggtggctcccacctgtaatcccagcactttgggagtccaaggtgggcagatcatttgaggtcaggagttccaagaccagcctggccaacatggtgaaaccctgtctctaccaaaaaaaaaaacaaaaatttgcccagcatggtggtttgtgcctgccgccccagctactcaggaggctgaggtgggagaattgcttgagtccctgaggcagaggttgcagtaagctgagattgtgccactgcactccagcctgggtgacagaatgagaccctgtctcaaaaaaaaaaaaaaaattcaacatatgtaaaattactttgtgaaattgatgtaaacattttaacttctgtatttaaccagtgacaggcaatgttggtctatgagtagtgctagttttgatgaaattcttctggaagtagcttcctgggctctaggtgcatatgtattcaatgccagagtttccagcacgtagcaggcactcagctaaatatagctatattattgaatccgcacaacaacactttgaggttgatggctttatcatcaactgattctttcatgattttgtagatgaagcaataggttttggtggtaaagtgacttgcccaacttcctgtagcaaatggtggtgatgggaagaatgactcccccaaagatgttcactggaacctgtgactatgtaatgttacatggtgaaagagatttcgcagctgtaattaaggttacagatcataggacaggaagattagctagattgtctgagtgggcccagtctgatcacatgagcccttaaaagcagagaactttctcaggctggagtcagataaatttgaaatgagagatttgaaatatcattgctcggaggggccacatggaaagcatgagaatggaatatgggcagctaggagcaaagactggatcccacttgacagcaggtaaggaaatgggtacctcagtcctacaattgcaagggactgagtttgcaagggactgatcctacaattgcaagggcctggttttggccaacaacctgaatgcactgccagtagggaacgcaactctgctaacaccttgatttagctttaggaaaccctaagcaggggatccagttgagttcacctggacttgtaattaatttgccttgtttgaaactgctatgtttttgcgatttgttgaggcagcactgcattagggtacaaatctggtggcagagctgggttcggattggggtgagccgacctgtgaaccccgcacggtgcctggcacatagtggatacttggatacttgttgaatgttatttttcccagtgaaggagagtgttgagtgaggcattgacattagtgagagaacatttgacataggggagggatggctttttttctttttgagacggagtctcgctctgtcgcccaggctggagtgtagtggcgccatctcggctcactgcaagctctgcctcccgggttcacaccattctgctgcctcagcctcctgagtagctgggactacaggcgcccgccaccacagccggctaattttttgtatttttagtagagacggggtttcaccgtgttagccaggatggtctcgatctcctggcctcgtgatctgcctgcctcggccttccaaagtgctgggattacaggcgtgaggtactgcgcccggccgggagggatggcttttataagcatagggtattgcacagttaaaatgtatttgttagagatagtcactcaatggtaaaattagtgtacaccaagtcactgcagtccggtctgagagagtgttgttaaatcagcttaatgattaaatcagcttaaatcagcagaagaacatgggcaattttttttttaatcagcttaatgagtagtgaccaccagcattaaaaaataaatagaaaatgccagactacatcataggtagttcagacaagaattgccggagatggtgtgggcgcctgtgggtcccagcatgaatcttgctcatgctgaaggtgagtaacaccttactcacgatgaaggtgttgccggagtgcctgtggggaacaatttataaattttgtttccagtgatttttacggatttccccatgtctcctcttccacatggtactgtattttactctttgatggtgattattctttctgttatccttacattctcgtgtcttcaccttggcatatgaagaagaaaacctcagtggctgtgatataccattttgagcattctccagtgtgtagcaccagctttcctgtggattgcagcccatggctgggagccttgcgtcactcccagcttccttctgccttgtgtttctttgtgctttctgccgtgtactttcctgtcttcacagctcacgttaactcctggctcatgaagatcttacttaattctcgcttttgtgtctttgactgttcaacaccttattaaaatgttctttgtctttgggaagccttcatcataggaagctttcagatttccactatctggtgattactttcttctagttccctaatttattttattttatttcattttactattattattttaaaaaatattatttaaaaaaacagacagggttttgccatgttgcccaggcttgtctcaaactcctgagctcaagcaatctgcctgcctcggcctcccaaagtgctgggattacaggtgtgagccaccgcatctggcccaggtccctaagtcttggtttttgcacttgtctcttactgaagttgaatgcctgctgtattgggcattgtgtcaggtgacacaggaaatgagccgtctcggcccttctgacagatgggggaagttaagatcagagaagttgaagtttactttgtcctaagtccacatacctattatattgtagaatgggtgtgttggactccaaggcatgttgcttttttctttttgtcttgttgccttttggtattcaggcctcacatagatgttagtgtatgactctgtaactctccaagaattcctattttctgttcacccacaaaatccactttttttttttcttgctctgtcacccaggctggagtgcagtgctgctgtgcatagctcgctgcagccttgaactcctgtgctcaagcaattttccttcctcagtctcccaagtagctgggactacaggcacgtgccagcatgcctggctaatttattttttgtaaagatggtgtctcactatgttgcctatgctggtgtcaaactcctgggctcaagcagtcctctcctctgggcctcccaaaatgctgggattataggaatgagccactgccctggccaaagtccacatttttaagaccttttggtcgtttaacagatttcatttattcagtaattttcccattgattaaaaaagtgctggtgcatgttctctgtatgtactatgtgcagctggagtagagtgtttgaaagggagagaataggtgtggtcacggagctaacaggagatcaagaggtatgtcctagccgagcacggtggctcatgcctgtaatcccagcactttgggaggccgaggcgggtggatcatgaagtcaggagatggagaccatcctggctaatacagtgaaaccccgtctctactaaaaatacaaaaaattagccgggcgtggtggtgggcgggcgcctgtagtccccgctactcgggaggctgaggcaggagaatggtgtgaacccggcaggcggagcttgcagtgagctgagatggcgccactgcactccagcctgggcgacagaggtgagtggattgaagtggggcaaggacaggagcagggtggtcagggaagaatctcttgatgtcctctgtgatggttaactttgtgtgtcaacttggctgggtgacagtgcccagatatttggtcagacactactgtggatgttttttgaaggtgttttttagatgagactaacattgcaaatctgtggactttgggtaaagcagttgatgctccttgaggtaggagggcctcgtccagtcagttgaagacctgaatgcagcgaagactgattttccctgaccaagaagaaactgtgtcagccgactgactttggactcggactgcaaccctttcctgggtctccagctagctggcctatcctgcagattttggacttgtacctctatagctatgggagctaattccttaaaataaatttctttctccacatcttgttgattctgtttctttagagaactatgactgacacatcattcaagcaagagataggatggtggcttagaccaggcaggtagctgagagtggaggatgtggggtgtggtaagcaatggtggcatttgggacatgttcttaagctagaggcaaggactctgtagctggagcaagtgtaggatgtgagtgggggagcaatcacaggtgacaccaaggtttctggcctagcaagtgacaggtgttgccttcaggtaaggaaggcgagactgcacgaggaattagtttgtggggggataccaggattgattttgaacatgttcactttaaaatgcctgttagacagcagtacatgtaggtggtctggagttgaggaaggaagtctggcagagctagacactgggaagtttaacttcgagaatgatgagatcccttaactaggatgtatcctagtgagtgggtgtagagagaagggcccacctggggtgcttcagtgtttataggtggatgagttgcagtgagaaaaggagactgagaacaagtggtcagagggacaccaggtgagtgaggcccactttaatcaacagcttgcttagtgccctgcacacgcatatcttaacactttcatgggaatgattttgtatattatttttcccacataagaacttattaagggtacagattatcagggaatctccacctcttggtgcagtacctgacatagtaggaactcagatatttgtttgaatgaatgacctaggaggtcacaataataataataatttttttttacaagagggagggcagggcatttggtgagtagataagtgtggcagagtgatgttacctatttaccatgtgaaaatggaagcaaggtaattactggtgataattattattttcagatggggtctccctctgttgccccacatggaatgcagtggcacaataacgtttcactgcagccttgacgtgggctcaagtgatcctcccttgatcctcccaactcagtctcctgagtagctgggaccacaggtgcatgctgccatgcctgacaaattaaaaaaatgtttttggagacatgggatttcactatgttacccaggctggtctcaaattcctgggctcaagtgatcttcccaccttggcctcccaaagtgctaggattatgggcatgagccaccatgctcaacctaggagaccccagttattgaatgcttacaatatgtcatgtccttattctagacatggtgagagttgcttcctcatgcagtcctgtcttgattgaatcataaatctctgtcttactcctcaagccatggtggattttcctaaggagtgtatcagagtgtgtatatgggtatacaatcaaacaataaaaatcacaatatcctggcaagtgtacgataaaatatttccagaatatgggtgcttctcacagtttacatagtcaccactctagaccaaaccactgctgtcatctcttgcctggattattgcataaaccttctatgtttggtctcctgacttttcaaccttactccccagtaatctagcacctagaagaatgcctggcatgatgtagatgcttagttaatatttgttgaatgatggcctggcatagtggctcatgcctgtaatcccagtgctttgggaagctgaggtgggaggatcacttgaggccgggaattcgagactagcctgggcaacatagggagaccctgtctctacaaaatattaaaaaattagccgggtgttgtggtgcctgcctgtagtcccagctacttggcaggctgactcagaaggatcatttgaagccaggagttcaaggctgcagtgagctatgattgcaccactgcacgcctgggcaacagagcaagagcctgtctctttaaaaacaattgttgaatgaacaaattcttgagtaaaccttcacacctgaggttctttgagcacatgtgtgatctcctgtggcatcgactgctgttaggataaaatttcatctgactctgcatctaggcttggcgagcgttcctccattgggcatctccttgtctgctgctctcgctgtgctctggtcacattggcattttttctgtgtcttgaagatagcaagctaattcccaccttgcagcttccacactgactcttctgtattcagtgcttcccgtcgctcccttcccattgcaggctcctttcttcatttgggaccctgttcagatacctccttagaggagtttcctgtgacctccgtagctaaagcagccctcccctcccttctttcccagtctctctagtcttttaaacaactttttaaccttctccaagtactgaactcctgcctccatccagtcttgtttgtgatagccaaaacccagcccttccagttacctttggattgtgattgtgtttttggcccctcccccatcccaaggggggaccagaatgattctgagatttctggcttgtagagttgagtacatgggtggtgctgtcatttactgagatagaaaatactagttgatgaaatgtttgaagaattatgcttttagagggtgtgtgtgtgtattggtactagctggttcctttcttgaattctgtttgttcctttagaacacaaaaaattctctatgactttggttttgaacatgttgattttcttttttttttaattttcttttttgaatggagtatactgaaggatgaacatgttgattttaagttgcctgtgagcatccaagaggaggtgtcacaggcaattggttctgtgcatttggagctcagagctcagttggggaagggacacggcagcctggatgtgaatctcctctctgccaatgagcaagccattggacgtatctgaggcagtttgctcatctgtcatatggggatagtatcacctactttataaggttacgatgaaatgagaatgcactcgtagtgcttagtatgtgcctggtgtgtaagagaattactttaatattattaaatggattgggctggctagtaatgctacctcgagagcctattatatgtcggggattgtgcagaatgcttttatgtggattcatttattctttctattccctagctaaatattgtagctcctgaacgaatgctgctttttcttgataaaacacacctgaaacattccagtcgtccccttcccacctgtgccccatatatgtgtgtgtgtgtgtgtgtgtgtgtgtgtgtgtatatatatatatatatatatatatattttttttttttttttgagatggtgtctcgctctgttgcgcaggctggagtgcaatggcgtgatcttggctcactgcaacctctgcctcccgggttcatgccattctcctgcctcagcctcccaagtagctgggactacaggcgccagctaccatgcccagctaatttttatatttttagtagagatggggtttctctatgttggccaggatggtctcaatctcttgaccttgtgattcgcccgcctcggcctcccaaagtgctgggattacaggcgtgagccaccgtgcccggcccccctttatattttcaatcctgattcctttgccagctttaggtattataaatagcctagtgtataaaaacatggatctgtcactattcaggaagttatttgtattaaaatttctatttgatttataggttttccagaaataactacagttttaaatgacgtataccaataccctcacaggatatgagtattaggtttgccaacaacaaagtgagagatggaaactcaaaacttaatatatttttcctttcttttttcaagcttgggtggaaaattaattaattgcatgtgggtgacttagagtggctaggattcgttttcatcctgaactgtccatagctgcttcagtcaccagaagctttttgccgggagttatttctccctgtctgaatacagaggatgaccctctcttggaagtggtatggtgttgtccagtggctgcttgaggagccttggagagtgaaggaaatgatttgcatctcttcatggcatatatttcctggtatgtatggtgggatgaccaattctagtaccgggcttcatatacaaacttcacgttctccttgtttctttaaatgaaaattttgttctcaccattaaggcactgatattttcttaaaactcacgtttgctacttactgtattcactgcacaataagcagttgtgtacttttcggggcatttatctctcccacacacagtttccactctaggaaatcttacagtgactgaagaagccaaaggtagtatgtaggaaaactgaaaatctcagagcaggaatgagaggtgtctttattttaaatctgcttgggactgtgtttgtcctgttaaaccctgatcaggtgggttgcattacgtgattgggatttaagaccaaatagaggtcagttgaaaatggtacacaagttggccaagaacgcagggagaataaagttaggagggtttttttttttttttttttttttttttgtggtgtatatttagttctagtctttttgaaaaaaagtgtttttttttttttttttttttgagacaaggtctttctctgttgcccagattggagtgcagtggtgtgatcatagctcactgcagcctttaactcctgggctccagtgagcttcctgcttcaacctcctgagtagctgggactacaggtatgtgccaccacacccagctagttccaattttgatacgtatatttttttctttttagatgaaagaaaaccagtaaatcttcaaatataaagttataattaggttccttggacttaactttaagaatgaattgtatcactttataaaaaaaatctgactaatgtataatttcctacttttaataaagttatgaaaagccagattttgtatattaaatattttgctatttcaccagagtataagtttaaattattcaccaacagtgaatgtttttctttgagagtagcagctactcatgttgctaaatcagtctatttatctttactgatagagctgagttttattacacgttcccttaatgttgagcttaaaagtactgtgattaaaaccaaagctgagcgttgggttaaagccctgcttcatttttaaactgcatgatattttttccctcaccgcccttctccccatcccctgctgagaatgatcgtataatgggatgttgacttctcatttctgttatgttgtaaagataggattcgtattaataatttatttaattctatatgtagcttcattgtagaataaaagtcaaggttaatatctaagttttgtacagaatttgtcagacttcatactaaagttgctttagttcctgtgaggtgggtttgaggtataagaaaatactgcaaacattttttcaaaatacttaggaaacattttagttaaaagcatactattcaatgaaaacatagcatgtttagagtggttaaaaaaagaacactatttaaaacataggctacatccacaggatactgaccttgtaacaaagaaaaacttgaagtcacatcactttttcttattcttaatattaggagttctaaggtgttcataaaaacccctctagttgtaagtaacttaactagatgggtgataatatggtaggttccatattctgtgtgagaacactgggaacctgtcctttgtgtttttgtctacgtaactggaaatggtgggtatttcatctttgtctgccctcttggagctgtcaccttggatcacagaaggagcagagcagtccatgctccctgagtcctccaggtcctcttgctcactccctctgtcagagctgcttaggaagtctttcagaacttgcttgaagatgtagactatttcccatggcagtacatcattttctgccaaaacttctcgaaatctagaggggaaatggtaatgaatattcagtttagaacattttttgttatatctctttatctccaaaatacagcttgaataatgtatacaagttacccaccttttgagtattttgcatgttgttttaaaattatgcttctagtaaagaaattttaaatgtaatttaaaacaattgctcaccagacatctacacagttaaagaatttacatgatagaatacagtttctagtcaaaatatatgaggaacttggacttagcagtagcaggaatcataagagaacatagtatttttacctgctgagaatagttccagtttggcaaggttgaacttgtgagcaaagaacttcaagttgtctttgttcagtcactgggatagttgtgtggggattctggtagtttctgagccagttgtaatccacacctgtttttttcactttttgttcattttcgatttcttgtattaatctctctcgctcctttaggtgccattttaattcccgaagcagagtctttgtcactatgtctgagccaggatagtgtgtgggtttgtaggaatcgtttttgggccatttcatccagccaaaaagtggcatttttagcctatggaaatattttcacttgtttatttgctcaaaatgttatgttcttctgagcaaatatttgtttctttacaataaatttgcccgaaaagtgcacgattttttttcacatttagctatgcaggtcaaaataagattagaacatggattaacgtcttaatttttaactaggtcagtggcagaaaccaagctttgaaaatgcttttatgtagcttagcagaaattagatatacaaagtcagagataacatatagactgaatgatatccgaaaataacactaacacttgctgtgaaaagttcttaagagacttaaaatattaatgtcggggcaagtgctgcctacagatacttttgatttatgttttggacagaaaaggtttaaagcttacctgttaagttgatgggctgatgtgatgttgccaaagagttgactgaagttggtgacgaagctgtgtttcactgggacgtatcttgctctcctaggtgtgtcctctgtagaaggaatgcgccaccttatttacccaccgaaactgtatttgaaataaataactttctgtgttaggaatgaggctgtgatgtcttcatttggagagaatgctcattaattcaccttgtaagtaagctagaagaaatgacaaaaataactgactatttaatcttcacaagttatataatggtctgccttttcaatgtagctcagtctatttgaaaaaaatgccagcagctatagatgctggtcctaaatgcattccgacatgtctttggtagtgaaacgaagaatggtcgtctaaagcaccatagatgcgctccgagctagagtgaagactgtcgcgtgatgtgatgctttgctgtgcatagctgtaggtcacagtttagtgctgtatttttatgcctgtagagctctaaaaatagccacgttgcttttattcttcagcttaactttcaggccatttggaagccgggtcactgtcccctctagtgaaaacaggaaaaatagattagacttgactatttgcaaaacatacattctgagaaaactcattgtaattgagtgaaataggtaaagaatgctgatgtgaattataattgtgaaatatttagcaaatgttacattttgtattcattttggttttttcaaaatagttaaatttgtatatttaagcaagttgaaatgctaggggacataataaacagctagataactttaaaatatactttataatctctgaaaatatggtaataaggcagtaattggttgtcagggaaaaatagaggcataagaacatacaaaattctaaacaaaatcttataattcatcgtagaaaaatcattttcgtgttttttttttggagctgaggatgaaaaacttatatttactatttaggtgcatattggtttgtaatggtcattattgtgctatttcttttttctttctttcttttttttgagacagagtcacgttgtgtcacccaggctgtagtgcagtggcatgatcacggctcactgtagcctcgacctcctgggctcaagtgatcctcccacctcagccccctgaatagccaggaccataggtgcatgccaccacaggtgcatgctacggcatgcctggctagtttaaaaaaatatatacacacgcacatatgtacatacatatatgttttatatatgtacatatgtgtatgtattttatatatgtacatatatgtatatatacacataagtatatatacgcatatgtatatgtattatatatgtatatataaatatacacacatatataatacacacatatatacacacacacatacatttcttttttttttttttttgtagaaataaggtctccctgtgttgcccaggctggtccgtaaactgggctcaagtaatccacctgcctcagcctcccaaagtgctgggattacaggcatgagccactgcgctggcctgtgctaatttcctatgcaagtgtttgtcttttgctaaagagtagatagtataaaaggtcttttactccccagttctctgtgaaacgactgcatagtggttttcccttttatagtatttgtttcttctgttgcttttcctttcaagtgagccatgaagagtagacgttgtttacatcagacttgcatgtcatgcatgacccagagtgacgtgtgtggccaccctacagctcctgttgcttagatgttagaaaaagccagatgtcaggactgattattgtcaactggaaggttttcacatgacattgcatatactgttaggagaaggaaaggagtaaagtttatgatgacagaagtgtcctaccaaattttatactaaaattacagcgaatcttgccgcatactcctttgaataacctccttgttactgcataaatttttttcctctgaaatggtaacaaaaatatcagaacatattggatatggaacttaagccaaatttctgttcaaggccctctgcagtctcacattatccctccttcaaggccctctacagtcttacgttatccctccttacctggcttgctttcttgctcgaccctagagcacaccttttgtttcagccaggccacgttgccccctgacgcttgccatgcttacttctgatccttcagctttggttcaactgttttttctcttctgaaaagctgcttctttgtgtttttcatgtatccacatagtaattctctttttcatggaccagctcaaataccaactgattttttccttcaacctgagggtcaatgtgaacatcttccttggcccttcttttcctttgaactctgattttatttatcttcactgttaaacttatagaaagactggtttggtctgtgtttctgttctctctccaccccgccccccacccttttttttttgagatggagtcttgctctgtcgcccaggctggagtgcagtggcgtgatcttggctcactgcaacctctgcctcctgagttcaagtgattcttgtgcctcagcctccctcgtagctgggattacaggcgtgcaccaccacactcagctaatttttgtatttttagtagagatggggttttgccatgttggccagctggtcttgaactcctgacttcaagtgatctgttcgtcttggcctcccaaagtgctgggattacaggcgtgagccaccgtgcccggcttcttttccctttttcctaatgctttccaattagatcctgctgtgtcctctactgtaattgctggctttcagtcacttaacagatatctattgactgtctgccagggcctgaatagttaggggctggggtgtagcagtgaacaagaaagacctagttcctactcccaaggagccagcctccaaatgtgaagacaaatataagtacacaaatcagtaaggtaattatagatggtcataatctattaatatacttggaacacttctcccacttagaactggaggtcagagaagacctttttgggtaggaggtatccttttaacagagatttagagatcaatgagctagccactggaagagcttcttgaaggcaatcttccttctccacttacttgtttgacacctttcttgccattgaaaccattaccaaagaccttttcagaacttttcttaccaccttaactcacattgagtataccttcctttgaagttaattgtgtaaaccaatttttctagtacttagtgtgtgctacttgccttacagattttattttgtcctgtctcctgagattatcagattgaagtagagacccaaataattctctgattacagtatttcttctactgctgtgtagatagagaacataaatatttgtaagcaaaggtaaggaagtatcttggattgtatttatcttacattataatgagttgaaaaaatgaattgtttctgatgaattgcaaacttcctaggatattttgtgtggacgacataaagcttaagctgttaggtcctttgctttttggtcattgtcatagttttctagtttacaccttgttagctaagtattaaattttataagacttaaaatgaaataggaccgtatcatgcataatatatgtgtgtctatgtaaaattttaagatctgtaaggaagtacataaaaagaaaagtttagaaagacaaaattttggaaccttgaaaagcaagctaaggagccagacataactttttatatattacaatcagggctgctttatatagtattcaacagcacttgattgcaatcaaagaaggatttttcattgtgggaagactcatatctttctgtttttttttttctttttttgagacaaggtattgctcacctaggctagagtacagtggcatggtcatagctcactgcagcctcagcctcctgggctcaagagattctcccacctcagcctctcaagtagctgggactataggcacgtgccaccatgcctgactaatttttaaatgtttggtggagactgggtctcactcaccatgttgcccaggctggtcctgaactcctgggtacaagcaatcctcccacctcagcctcccagtgtgctgggattataggcatgagccactgtgcccaacctgtttttaattcattttgctactgaattaaaagttctgggttattgattcatttttcttaaggtaaaaagtacatttctgtggagttgttcatattaaaaactctcaacaaactagaaatagaaggaaactactagcataataaaagccatatgtgaaaagcccacagctaacatcatactcaatggaagattgaaagcttttcctctaagatcaggaacaaggtgaggttgccgcctttcaccacttttacttaacttagtactagaatttctagccagagcaatcaaggaagattaagaaataaaatgcatccaaattacaaaggaagaagtaacattatctctgtttgcagatgatataattttatatgtagaaacccctaaagattccacaaaaacctgtcagaactaataattgaattcagcaaagtagcagtctacaaagttaacacacaaaattcagtctcatttctataccctaacaatgaacaatctaaaaaggaaattacaaaactattctattggtaatagcatcaaaaagaataaaatactcagggattaaccaaagaagtgaaagtctggacaatgagaagtgcaaaacattgctgaaagaaattaaaaacataagtaaatggaaatacatcctctattcatggattggaagacaatattgttaaaatgtcagtactacacgatgtgatctacagattcaatgcaatctctgccaaaatcctaatgacttttttttcataaatggaaaaatccatcctgaaattcatatggaatgtcaaggaaccctgaatagtcaaaacaatcttgaaaaagaagtacaaagctggaagactcacatttcctgatttttaaattactacaaagctacaatcatcaaaacagtatggtattggcataaagacgcatagaccaatggagtagagagcccagaaataaaccctcacatacatggtcaataattttcagtaagggtgccaacaccaattaaggggaaaaggacagtttgttttttttgtttgtttgtttgttttgttttttttgtttttttgtttttttttgtttttttagatggagtctctctctgtcgcccaggctgaagtgcagtggcgatttctactcactgcaagctctgtcccccaggttcatgccattctcctgccttagcctcccgagtagctgggactacaggcgcccgccaccacgcccggctaatttttttgtatttttagtagagatggggtttcaccgtgtttgccagatggtctggatctcctgacctcgtgatccacccgccttggcctcccaaagtgctgggattacaggcatgagccaccgtgcctggccaggacagtcttttcagcaaatgatgctgagaatagtggaaatccacaggcaaaaaaatgaaattggattactactttacaccatatacaaaaattaagttgaaatggattaaagctcaaaagtaagacctaaaactgcaaaacccttaggggaaaactgagggcacaaacttcacatcgtatgtggcaataatttcttggatatgacaccaaaggcacaggcaacaaaagaagaaagacaaattggacttgaaagatttgtatatcaaaaaactgaacagtaaaaaggcagctcacaagatggagaaatatttgcaaatcatgtatctgaaaagggattaatacatagaatgtatagagatttcccaaaatgcaacaagaaaaaaacagatttttatttttttaagagggagggtctcactctgttgcctaggctggagtgcagtggtgcaatcatagctcactgcagtctcgacctcctaggcttaagggatccttctgcctcagccttccaagtagttgggactataggtgtgcagcagcgtgcctgctattttttttttttattttttgtagagacagggtcttactatgttgctcaggctggtcttgaactcctggtttcaagtgatcctcccaccttcacctcccaaagtgctgggagtataggcatgagtcattgcacccggcaaaaaagttgattcaaaattggcaaaacaggagttggtgaggatgtggagaaattggaacccctgtgtactgttggtgagaatgtaaaatggtggggctgctgtggaaaacagtatggtggatcttcaaaaaattaaaaatagaattactatatgatccagcaatttcacttttgggtatatacccagaaaagtttaaaggaagaccttgaagagatgtttgtacacctgtgttcataacatcattattcacaatagctaaaacgtggaagcaacctgagtgtccatatccatagaaaggagtattactcagccttgaaaaggaagaaaattctgacatacgctctgacatagatgaaccttgaggacattatgctaaataagccagtcacaaaaggacagatactttagccaggcactatggagtgtgcctgtagttccttctacttaggaggctgagatgggaggattgcatgagcccagaagtttaaggctgcagtgagctataattgcaccactgcactccagcttgggcaacagagcaagaccctgtgacagagtgagactccatctcaaaaaaaaaaaaaaaaaaatccttgaaaggacaaatactctgtgattccacttatatgagattccctaaaggagtcaatatcatagggccagaaagtagaatggtatttgttggtggctaggaatagagggaaatggggagttattgtttaatgggtacagagattgttttacaagatgaagatttctggagatggatggtggtgaaggttgcataacatgaatgtatttaataccactgaactgtacacttaaaaatagttaagatggaggatacctttgttgaaagaattgtgaatagcatgattcatttctagcagaggctaagtttaggacagcagcttccattgagaagtctttctgtgtcatgaatagcattttaatgacctcttggctcacataagcaaacaacagggatgtatctgctatgaaaatccatgaagcaggggtctagatgagattatatgatgatgtcttgcaatgtgtaattcattttgctagtagaagaattctttgtagaagttggcagattgaagtgtttttcaggggagtaaatcctccaaacaaaaacaatccaaaatatagtcagttcaagtcctgattttagttctactttgacctctgattataaacaatttcatgtatgttcttactgcttctggttatgccacccagggagtcgtgcaatatgcataacacaatggtcaacctcatatatttgtgattgcaacaataactttgaaggttatgactcatgaagacacagaagctctaaacgctggctttgccaatttattttattttatttttgaaacagggtctcactcagtcgcccatgctggagtgccatggcaggatctcggctcactgcaacatccgcctcccaggttcaagtgattctcctgcctcagcctcccgagtagctgggattacaggcgcccgccccaccactgcacctggctaatttttgtatttttagtagagacggggtttcaacattttggtctcgaactcccgacctcaggtgatccgcccgcctcgtcctcccaaagtgctgggattacaggcatgagccaccatgcccggccagctttgccaatttaaacaaatcaggccctgccctgccctgccctgccctcttctgtttccttccttccctttttttttttcttttgatgggccctgccctctttccttccttccttttttttttttttttttgatggagtttcgctcttgttgcccaggctggagtgccgtggcgcaatctcagctcaccgcaacctccgcctcccaggttcaagcgattctcctgcctcagcctccctagtagctgggattataggcacgtgccaccatgcctggctaattttgttatttttagtagagacagggtttctccatgttggttaggctgggcttgaactcccgacctcaggtgatccaactgcctcagcctcccaaagtgctgggattacaggcatgagccaccgcatacggccggtttctatttcataatcaaataaatgtcccttcttccaccacaatgattaaactatgtatttggttccaggaggtattttctttgtcagttattgtgctgagcaatttaatcttgaatttagaaactaatcttcttatgaagaacacaggaagatgacgccaggtctaggacttggaagtctgcattatggaaggatatggaaatgtgacatttgatcacgggaggttagagagaatgttagaggttcagtctagtaaataatggaccagatacactatgtgaatgaaatattgtgtacctcatctatttgctcatcaaacgcttagcaaaaaccgcatgtgtgaaatgtgtcagagtcaaaatggagtcattaatgttaaaaccctgacgaacagagccagggaaggccatgaagagaggagtctcacacttgtatgttttataacaaaaaagactctacaaaacccacaaccttgcacaaaggccatcacaacctttctaaaagaatatttctccaaggacatctgcccagccactgcttgaccagcttcagactagcatcaccctgtttgtgatctttgtagccaaggataattatttcagaacaattgtgtactactaatttttccctttaaaacctttgtctttctttacttccctgaatacacaaatcatttactgtgctatgtgtaattcccatcgcaatgctttattcccaaataaagatctttccttgttaaaaaaccaacaaaaaaaatccatcaatttttcagagagtgccctaaacacaattttatatgcctcactggttgttaggttattcctgcacttgactttatcattgtttactactagtaaaaagcagcattgccaaataatccctgattttcccctaaaatgatgttaagctttttgaaaagttcaggttaaacttactgttgttagattaatgtatttgttgcttccctttatctggaatgtgtcattagcttttttattttaaccccctttaattcttaattccatgacttaaggtttgagagctaaacactgggacttctggataacacactgatagtttgcataattataatcggcattgtacatagaaaggatatggctaccttttgttaaatctgcactttctaaatatcaaaaaagggaaatgaagtataaatttttgtataatctgtttgaaacattttatttgcttaatattagggctttgcccctttcctgtaagtctcttgggatcctgtgtagaagctgttctcattaaacaccagttaagtccattctctggtactagctactaattcagttttatattctacttcacaatttaaataaactgaaatatttctttttttttcttttttcttttcttttttttgagacggagtcttgctgtgtcgcccaggctggagtgcagtggcgtgatctcggctcactgcaagctccgcctcccgagttcacgccgttctcctgcctcagcctccggagtagctgggaccacaggcgcccgccaccatgccaggctaattttttttgtatttttagtagagacggggtttcaccttattagccagggtggtctcgatctcctgaccttgtgatccgcccgcctcggcctcccaaagtgctgggattaccggcgtgagccaccatgcccagccataaaaggaaatattttttaaaaaaagtagttaagatggcaagttttatgttatatatatacacgtatatatatatatgtatatacgtgtatatatgtgtatatatgtgtgtgcgtgtgtgtgtatatatatatatatatatatatatatatattttttttttttttttttttttttttttttttttttttgaggcagagtctcgctcgttcgcccaggctggagtgcagtggtgcgatctcagctcactgcaagctccgcctcccgggttcacgccaatcttcctgcctcagcttcccgagtatctgggactacaggcgcccgccaccacccctggctaattttttgtatttttagtagagacggggtttcaccgtgttagccaggatggtcttgatctcttgacctcgtgatccgcccacctcggcctcccaaagtgctgggattacaggcatgagccactgtgctcggccttatgttatatatatttgccacaataaaaagattgaaaaaaatgcagttaatatttaaggagaaactgatattgaatttctttttttcagtattttaattaaaatactactgcatttaccttttaaagttaaaagtcacatttctatgcgtttcattcttatcttagtgatttataggaattctctctcttttttttttttttttttttttttttaaagacagagtctcactctgtcgcccaggctggagtgcagtggtgcgatcttggtgtactgcaacctctgcctctaggtttcaggcaaattctcctgcctcagtctcccgagtagctgggattacaggtgctcgccaccacgttgggctaaattttgtatttttagtagagatgaggtttcaccatgttggccaggctggtctcaaactcctgacctcaggtgatccacccgcctcgacctcctaaagtgctaggattacaggcgtgagccaccgtgcccagccaggaattaaagttttgctgcaaatgttttctttcagatgatcacctgctccccttcacctggtcagagccatgctgttaaactaaaagtcagatattgttatttctctctctgctcaaaacccatcttattcagaacaaaagccaaaatctttataattactcccagctcctccctgatacttccagctcttctccatacccttctgctccctaccctccatttctcatcatcctcttcccgccccctcctgtgggagccacccaggcatcttgactctctcagctgcacctggtacactgttattgttgagtgaattaatgagtaaatgtcaggcaaacagtaaccagaggaatgctgatattttggaacaggtaaaagttggctttgatgcaaacagcattttattaaagtgtattagacaggattctccagagaaacaggactaataagatatatatagatctgtaagagggggagattggtgatgacacttggtgcacgtgattatggaggctgagacgtctcactatataccttctgcaagctggagaagaaggaaagttggtggtgaaattcagtctgaatttgaaggcctgggaaccagggtaactgatgctgtaactcccaatccaagacaaagcctgagaacctgggatgggagatggctggtgtgaatctcggagcctgagggtctgagaatcaggaactctagtgtcccagggcaggagagactggatgtcccagttcaaaaagagagtatttacccttccttatcctttttgttctgcccgggtggactctcagtggactcggtaatgcccatccatgttactgaggcaggtcttctttactcagcctactgattcaaatgctaacctcttcctgaaacaccctgacacagccagaaaaaatgttttaccagctatctgggcatcccttggcccagtcaagttgacataaaattaatcattacataaagtttgtctcaaatttcaagaatcagtatcatatagtctctttgacaacagtgcatttaaaccagacactgatgaggaaaacatagttgatagcatataatacatatcacaattgtcttttttcacttaatattctggacatgtttatctattggcatgaatagagccatgacactttcaaaatgatacacattaactaaggtatgccattgttttagcttgtcccctgttggacatgtttttcaggttttaattattacaaatattatgaaaatatacccttcctccctggaatccttaatagcgtcacccgattttaattttgtccacatctctaatcagcatcttacgtatctattatgtctccttcacaagaatggtagtttcatgtgggcaaggactttgttttgtttcctgctatatctttagtgttggagacagtgccttttgtgcagtaggtgttcagtaagtatttgctaaacaaatgaatgtttccatgcatgtctttgcacgtgcttcgtttacatgtgctgatgtttaacaaagattctgaggaaaagttggattgtaggagacgtgtgttttaagttttggttagtttttagtttttatttgatttattttttttgagatggaatgtggctctgttgcccaggctggagtgcagtggcaccatcttggctcactgcaacctccgcctcctgggtttaagtgattctgctaccttagcctctcgagtagctgggattacagggacctgccaccacacccagttaatttttgtatttttagtagagacagggtttcaccatgttggccaggctggtcttgaactcctgacctcaagtgatccgcccgccttggtctcccaaagtgctgggattacaggcgtgagccactgtgcctaggctgtttattttttttttgaaacagggtctcgctttgttgcctaggctggagtgcagtggcataatcttggctcactgcaacctccacttcctgactcaagggatcctccagccccagcctgctgagtagctgggaccacaggcatgagcccacacccggctcatttctatattttttatagagatggggtttcaccatgttgcccaggctggtctcgaacttctgagcacaaagtgatccagccgccttggcctcccaaagtgctgggattacaggtgtgaaccaccatgcctggctgttttaagttttaattagctgatttcagctactcaggaggttgaggtgggaggattgcttgaacttaggaggttgaggttacagtgagctatgatcacagcactgtactctagcctgggtgacagagagagaccttgcctcaaaaaaatgatactgcaaactacccttcagaataagtggtcatacccatttaccataaatgtatctctcctcataaatattctgaaaatatttgctctttttgccaatttgatgggtgaaaaaatggtttgtcattgttttaatttgcatctgcctggtaactgagtttgagtgtatattcatttgtttattgactatttgcattttttcctgtgacttaatgtgaaaaacttgtctagtacacaagggtttcttggctttttggaaatagtatactaacttttactattcttttcaggtcactcagccaaaggagctcagaagtagagtatattaacaaatacagacagctcgaagcacaagagcttgatgtgtgtcgcagtgtccaaccaaccagtgggccaggtaaacaggtctctttaaatattttagataggatgcatgagtggttcacatgctaaaatattaggttcatagtgcatgcctgtaattccagctactcaggaggctgaggtgggaggatcacttaaggccaggaatttaacactagcctgggcaacatggtgacactctgtctctacaaaaaataaaaaaactagctggatgtggtggtgtacatctgtaatcccagctactcgggaggctgaggtgagagggtcacttgaggctaggagttcaggttcatcctgggcaacatacggagaccctctctttaaaaaaaaaaaaaaaaaaaaaaaaaaaaaaaaatatatatatatatatatatatatatatatatatatataattattaggccaggcgcagtggctcatgcctgtaatcccagcactttgggaggccgaggcaggtggatcacgaggtcaggagattgagaccatcctgaccaacagggtaaaaccccgtctctactaaaaatacaaaaattagctgggtgtggtggcgtgtgcctgtaatctcagctacatgggaggctgaggcaggagaatcacttgaacctgggaggcagagattacagtgagccaagatcgtgccactgcattccagcctggcaacagagtgagactccgtctcaaaaaaaagaaaaaattattagaagcctttaagaaatatagtggcgaatacaaaaattagccgagcatggtggtgcatgcctgtagtcccagctactggagaggctgaggcaagagaatcgcttgaactgggaggcagaggttgcagtgagctgagatcatcctaaatagtctgttcttcggaagactaataatggtttcttaccttgctattaattaaaactacttttttttttttacaataaagatattaaaatgacattttaaacaatgcagaaatgtataaaataaaaaagtaaaaggtccttcttaaattcccagttcccaagagtacaactgttcagagttcaccgttagttactttctgtgagtatggagtttttttctgagcaaattatcttactagcaccaggccctattcatatgctagaagttatcttttgattttttttgctttatgagaggtcatctgtcatagatttctgctagttcagttgagaagctctgcctcctgtcctgccatcctgcgtattagtgtgctcagagtcgggcacaaatgtgggttcaagtaacactttcttttttagccttttaaaaagtatgaaatacagtcaatacataatagtagattaatccttatcattcttgggattgatttaggcttcttgactataccaattagtaccttttaattagtctaggaaaattctgagccatcatctatggcccactctttcatttagttttgtgtttttcatttttttggtcagtgtgctctgttctggttaatttctgctagatctatcaccttaaggtaaaagcagcctttggttgtttgcctccctttctgtgttcttgcctcatcacaggctttggcctgatgtctccttgctatttcatcagccctttggtgcttttaaggagaggtttgtgtatttcatctaacatctttagttgatctcaggaaggagatttgtctgaacaacccagtgtattaacagaagtgagcattcacagtgtatgttatctctggtccaatttctacttatgctaagaaaagtacaaagttgtacgtataagaatgtttattgaattgttacttaatctatgggaagtcttaagaatctcctatatgccagtgaacagaggattggtgactttggtcttttgtacaaaggaagagtactgtgcagctttggaggtaggaagtagccgtatgtgttattgtggaaagagagccatcatctaatacttctgtttggaaagcacattagttagtttatagatgactctgtgtgatgtgatccttcttgtcacactcacgtactggcccaggggcacaggcagcagcccggcacaccctgcgtgctgggcctgtagcgtgccggatggattaccactctttaggactagctagattacaaatgaatgcctgaaactcgaagtgtctgttctcatacttttaagttcatatgtgaaactctctttgctttctttatgcatggtatcataatatatttggggcttttctctgggcagtcggatcaactatggctttggctatttatggaggtttgggctacttagccactgacatttatcaaggtgtgttccagggactgtatgagacagcgagaatatgacaagtaaaaaagactttaactctgatcatctctgatcattgtagagatgatcatttagtcatccagttacacaaataaatgctttttggaaataagttatctgaaagccagctctatgggggtgtaaaacaaggatttgacttgggctgtggtgtcaggaaagtaacagttgagctttgatctgaagggtgagtggaccttactgaggcagtgtgggggtgcagggagggaaatgtgtgcagaggccttgtgctgggaggaagcctggtattccagccctgaaagaggggccagtgctgctagggagtagacagtgggtgtgggagggctgggcagggtcagctggaggctaatagcctcctaaagaggtccatgttctaatccccaggacctgtgaatatatcaccttcatggtaaaggggtctttgcagatgcaaattaaggatcttgagatgggaagattttccaggtgggcctaatgtcatcacagggtttttcctagagggaagcaggaagatcagtcagtagtagatgtgacaacagaagtcataggttggagtgatacaaggaagaggccatgagccaatgcaggcagcttctccatggctgataaggcaagggaatagattcttctttacagagcctccggaaggatccagcagccatgccaacaccttgtccttctcatctttgaacctctgcttccagaactgtaagagaataaatgcatgttttaagccactaagtttgaggtaaaatgtgacagcagcagtaaaaaactaacacacttgtattggatgaggttggatgagataggcaagactagtaatagggcctgtgggctgtaacgaagagttttggtcttaatactcagagcagtgggaaggtatgaaagtttccatgcttttcttgggatgactgtgaagggaggaagagggtgtcatgtgtttagatttgtgttttacaaaaagtgctttggtcatatttttgagagttgattggagggggccagagtggacctgaggagaattggaggcattgtcctagtccaggtgagacttgatggtgtctttgacagaggatggcagtggaggaggagagccagttgaaggacaaaccggacaggaattggtgatgccttggacacagggtgagggaggaggccacaggaggcagagaggtgctgtccacttctttttccttgagatgaggtcttgctatgttgcccaggtaggccttgaactcctagactcaagtgatcctccagcctcagcttcctgaatagctgggactgtaaacatgtcaccgtcatgtctgctaaatgttttgaagtgttgaagtgcctctggagcactgaagaagtaaggtcaggttatcgtgtgtgtgtgtgtgtgtgtgtgtgtatgtatacatacacacacacacacacagacacaaagctatttctatgtctatttctattaaaaccatgagattacactgatgcctctaattccagtccagtgccacaggtttcagcatgaacattttgttatatccagttataaaataatttgattcaaaacacttttgattttggcctgatacaggtgttatttcacttataagtattaaaaattatttctaaatagaaatccaaggacacccattcagtgaatttctatcgattacagtagaatcattttacatggttaaagattaatcattttttaaaaactgagatttatttgcattgataaatgaaatctttccttacagtgtgagcctagttctaggttgtcgactcctgaagggttctgttgctttcacacaacaatttgaatttgtcctgggatacagtctttagattgtagttaaattccacagtgctgcctccttttaaatgtggtgatatatttagtggctgttttcatcctccttttagcttttcttctggttttaagagaatggcctatgtggaatgtctaataaccgaaagagaaacattattcttccttcaagttaattttgtattcagaatactagtccatatttggagaaagtcatatataattatctatttggaagatttaattttatggttacatcagtaatccagtaattaaaattattttctgtaatatatagtgtgtagatttgaagataagtcttaagttcaccatgtgaactgacatacttaccagttaaaattccttacatgctgtttagaacctctaggtgctgaactttttggttagatttcatatttggttgatggtgatatagtgatatgtcttagtgaagagaactagcaatttttatggcttccagttttccccagttcatgtaaaacattgtgttgttaatcatgtaggataaagagacagcaagaaaataagaatagtcaattttaaggttgagctggtcctcatgccgtttttggatttttgctttgttgtatgtagtttgttgatttgccttaaattatccgtgatggatttccttcttattctgttgctgatgcaaaggtgcgagagccacacagctgggaacatttctgctgtttggtttcctgtctgccctttggcagtgtacgcggaggcaggacttgatttgtgctgggtctgcttcagccagtgacctaaaaatgtcagcttgtgttttgcgttacatggagaaggggctatggtatagacagtaccgttaggacttctggcattttttcttgtaaaatttctgtctttaagtagcagtcttcaaaatgcatgtaatcaagtaatgtaagccaatattgtctaagtaacagggcttgtttagcggcatgtgagccagggcttgaagtcttttagcaaaacgaacgtggctgcagcctttttcgtctttctaaaagaatctttgtcaccttctttcccctttgagtagctcttcctcagcttcttactcccaccctgttcctcactagaatacttgcctctccctttgtctgcatgctgtgtctgggctcagggccttctttctctcagtccagttcacaagggccatggggattctcttccccttctttcattatgttcaagaaggcctaggtatattaactgggaaaacaagaaggcatcagtaattaccatagcactgagaagaggaatggaaggaaagtgagacgtgataatggaaagaaaatccctgttttagtaaacttggcaatcactagttaggctgattagaagattaaaaagccataggtcaggcgtggtggctcatgcctgtaatctcagcaatttgagaggccgagatcaggagttcaagaccagcctgaccaacatggtgaaaccccatctctactaaaaatacaaaaattagccgggtgtggtggtgggcacctgtaatcccagctactcaggaggctgagggaggagaatcgcttgaacccaggaggcagaggttgcagtgagccgagatcgcgccactgcactccagcctgggggacagagcaagactctgtccagaaaaagaaaaaagaaaaagaaaaaaggaaaaaaaaaaaagccatatcggcaggacagctttcctgagttaggggtcactaatattttaggaagaacatactcacaaagaagctatttttgctttgagaaagtatgacagatctggttcctctgtttatataattgagaacagggaccacgtaactttgattcaaatgtgggaaaatagccacattttaattacatgttattagaccagttaggaaaatgggaatatatgtagggaaaagatgtaggaaaacaagagagaagcctggttgtgtgttttattaggaaaggccgagggtgacacagcaggagatgctggtcagaaacaaggggctgataggaagggaaggtgagtcgtggggtaagggaatgagtgcggtgctaaatttggctaagagtttattttggaagtaaaacttatttcccagcaaaagtttgtcttccgtgagttttgatgatttgccagtttgtcaagtgatgaccagaggtttagaatttgtagtgcagccagagagcagggcatgtttttacaagagggcagagaagtgtgcctggtcagagctctgtgtcatgtatcctgagcagaggcaagctgcctgctttcctgatacctgtatttcataaattgtttgatttatttattgctatcactgatgtattttagtagcagggaatgcacacttaaattgatgcattctgttgaaatttcaaggaaaagttttctctttaactgttttggtaccactgaatcagcaatgagtgcgtgttttacaggcctgttttagaaggcagtgctgagcttgcaatattggtggctgtgatggagggatagaatgttctcagtttgcttttatacaagattaatagtgggctgctaagggaagtttcttaagaaattaaactttttattttagattcgggggtgcatgttcaggtttgttacaagagtatattgggtgatgctgaggtttgggcttccactgatcccatcacctgtatagtgaacacagtacccagtaggaagtttttcagcccttgcccctccctccctcttcttcttggagtccctagtgtctgttattcccatctttatgttcgtgtgtacccaaggtttagctcccagttgtgagaacatttaatatttggttttctgtttctgtgttaatttgcttagatggcctccagctacatccatgttgcttgctgcaaaggacatgatttcattcttttttatggctgcatattattccatggtgtatatgtaccatgttttctttatccaatccaccattgatggatacctatgttcgttccatgtctttggtattgccctgatggcagttttagcctgtagaaaatgtatttttgtatttgagtgtgtgtgtgtgtgtgtgtgtgtgtgtatgctgtatctatagattagaacattgagttatctttttccagataagaaatggcattgtatttgtttgttttgccttaatccaggtccaaggccatctttggctaaattaagcagtgtgacatgcatcccagggacaacttataaatatcctgatttgcctataagtcgatacaaggaagaggtaaaattgttttgttatactgtaattttgctgtttgaatacatgtctgaggcccaatacttttggtttctaatttgaaagttaccagttgccaggtgaacacttctgtggtgtacaaggttctgtggtggataagaggagggtgtgctcaggccaacctgcagatgattttgtgtagtaaccatatcgatggcttttcttttgatctgtgctttaatttctttagtcttcgcctgagtacatcttctaacatttagtttatctagtctttccttcctcaaaatatctgcaagtaaacacttagtcttccccaggagagcttcttgtttaaataaactcactgctaaatgtttttatgaagcaaatgacataccctagcatttccactgggttttctttacagcgttggccctttctctgcctgttgattaatgtaatcaatcattgacataccattgtattaacaatgccaggcagatgtaacagtaggacgattaagttcctaattacttgcgtgttattaagcatcgttaagagtaagcgtatcggaacctttattaactggaagaaggagttacagataaaactagaaatgtttcaaatttaatttttactttgctttagagtaaatcatgcaactaaaaattagaggccagtattcaaattaatttgtatttcctgaccatatcaattgttagaaggataagagcttaaataagtttagagtggaggtcggggagttctggaggaggaatttgagtggagttttaaaaatgctgcatataatctgtaagtggaaaagtggaagttacttgtttccaaatatgtctggaggtgggaggatcacttgaggccaggagttccagaccagcctgggcaacatagcaagacctcatctctacaaaacacaccccccaaaattagtggaatatggtggcacgtgcctgtggtcctggcttgggatgctgaggtggcaggatggcttgagcttaggaggtcaaagctgcagtgagccatgattgtgccactgcactccagcctgggtgacagagctagagcctgtgtctaaaaataaataaacagatatttaatagataaaaatatgtctgaagaatttaagatgacattttaaaaccacttgaatgtagtaacagctctttttctcatgttcagtagaattatttgcagattcattacaaaatgttaatagaaacttgggaagagtcatagaaatctaattttacattttcatttttacagaagcagttgagacccaggaagctggagttaacctggcctggtttttccacagctatcactagttactattttttttgttgttgtttttgtttttttgtttgtttgttttgagatggaggcttgctctgtcgccaggctggagtgcagtggcacgatcttggctcactgcaacctctgtctccagggttcaagcaattctcctgcttcaacctcccaagtagctgggactacaggcgcgctaccatgcccagctaatttttgtatttttagtagaagcagggtttcaccatattggccagaatggtctcgatctcttgacctcgtgatccgcccgccttggcctcccagagtgctgggattgcagatgtgagccacctgtgcccagccactaattactgttaaataggtagtagagttgcatttaagtgtggcaaccgtttgtcgcctccttgctctcttgtgttgtgtttagaatggttaattaataactttaagcaatttgggaaattgctggtaatcccagcaatttgggaggctgaggcaggcggatcacttgatgtcaggagttcaagaccagcctggccaacacggtgaaagaaaccctgtctctaccagaaatacaaaaattagctgggtgtggtggtacacgcctgtagtcccagctacttgagaggctgaggcatgagaatcgtttgaactcaggagacagaggttgcagtgagccgagattgcgcccctgcactccaggctgggcaacagagcgagactccatctcaaacaaaacaaaacaaaactttaagatgaaagaaaaataaatcctgaaagacttcttaatataggtgatactttacattgccattttgtgctgattttgaaagaattttttaaatttctaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtgagactgggagggagggagggactaagagagccagctgtctctctattccttaattttattaagtttttttctgtgtaagttgatagtatgtgaccattttctgctgaaaattagttgtgtctcatgcctgtaatcccagcactttgggagaccgaggcaggcggatcacattaggtcgggagtttgagagcagcctggccaacatggtgaaactccgtctctactaaaaatacaaaaattagccggatgtggtggtgcatgcctgtagtcccagctactcgggaggctgtggcaggagaattgcttgaacccgggaggcagaggttgcagtgagccaagcttgcgccactgcactccagcatgggcaacagagtgagactctgtctcaaaacaaaaaacaaacaaacaaacaaaaaaagaaaccagctgcttatagaagagaactgtggcataattttaaaaagcagtgaaacagaatttcttgaaaataaggctgggcatggcggctcacgcctgtaatcccagcactttgggaggctgaggcgggcagatcacttgaggtcagaagtttgagaccagcctggccaacatggtgaaaccccctctctactaaaaatacaaaaattagccaggcatgatggcacatgcctgtgattccagctactcaggaggctggggtatgagaattgcttgaacccgggaggcagaggttgcagtgagctgagatcatgccactgcactccaacttgggtgacaaagtgagactctgtttcgaaaagaaaaaaagaatttcttgaaaataaattgtaatttctttccagttgaataggaaagcagtaagaattctcatgcttatggcttttataattttatctttttaattatatctgtaatctagaagatgtcttgatacacaattgttttaacataaaaatgttatagcagtgtgattagatgagccaacccctgccgccctccccccaaaaaagaagaaaataattgacttgagaatgtcacttttaatttggagcctgtgtatctttcgaaataccttaatttttcattccctttcttacccccattatattaataaaatggacataactttttttttctcttttttcctttcctttttccttctccaattttaggtagggctagagaaaatagcaacagaggacaccaggctaatttatatgacaactggagtcctgcttcagaaaatagttagtgccaagagtttgatggaattcacacatatcatcattgatgaagtaagtgatgtcatctacttgtaaaggtcatatttatctctcttaaaaaaactctcagagtattgtgaaccctgtctttgtgcctgtctcagctttctttattttttccttcccctttactttctggacttttctcagtaaggatggaatgttttttgattttgtttatattttaaacatgagttttttggtggggaatgttgtgtttgaataactttcccaagaactttggtactggttcttaaactcttgtgttttaaaccttatcagtaattctgtttgggaagcttgacttatttctagaggaattagacacatcagcaaataaataggatttgtgagaggttgtgagacaagggtagggtgtttaatagagtctgaaatcaaaccatttgggcaacgggctcatgcctgtaatcccgatactctgggaggccaaggtgggtggatcacttgaggtcaggagttcgagaccaacctggccaacatggtgaaacccatctctactaaaaatacaaaaaaaaaaaaaaaaaaaaaaaaaagattagctgggtgcggtggcacacacctatagtcccagctacttgagaggctgaggtgggagaataacttgaacctgggagatggaggttgcagtgagctgagtttgtgccactgcccttcagcctgggcaacagagtgagactgcgttggaaaacaacaataacaaccaaaaggataaacccatttgggcaactgtttagggtagtgtctctgcactctattttgatgcatgggataacgaataatacaacatatactccaggcaaagctgagtcagtgcgtttgtgatcttatgtacaggcacttggttttaaattattgtagggcatttggtgggagagtaggagagggtgaaaatgatctactgtttcttacaaaatagggtgatatataatacggttcagaatttttctttatgacttatggtagttttgaatatctttatagtaggtagagacaaattcagatttaatagataatatgccaaaagatggcattatgaaggttgtaatagttattcattgggctttttagtataattgagcccactttacataaaaggaaactaaagtttaaggaagttcagtgctcaggccacaagtaattagtgatgttgctgggttcatccctgggtagtttactctagaggctgtggtgctggtgcctacatttattttctgtgtgtctgacatatttctctgcctacgtggcctttgcacacccatacttgagtgacacagataaatccatcaatgctgtgttactgactatatccttttctcaagctctgccttaatagctgagcaaaagttagctcctctcttcgagagcttgccctactggggagcggtaaccaacagaagaccatcgcgccatcacggcagcttcctgctctgcctctgtctggtgcggtgtcagcaccttgtagatgccccagggattatttgcttcataaatgaatggactggattcaactacctgaagttttaggtttacatatagtatcgtttgcattatctgggattatttgaatttcaaaacaaatacaagaacaaaagttgaagatagccagccagtttaaaatggaataatgttttaaactttccagctcttaaggataaagtagcttgggccgggcacggtggctcacacctgtaatcccagcactttgggaggccgaggtgggcggatcacgaggatttgtgagatcaggagatcgagaccatcctggctaacatggtgaaaccccatctctactaaaaatacaaaaaattagccgggcgtggtggcgggcgcctgtagtcccagctactcaggaggctgaggcaggagaatggcgtgaacccgggaggcagaggttgcagtgagctgagattgcgccactgcactccagcctgggcgacagagtgagactctgtctcaaaaaaaaagaataaagtagcttggccgggtgcggtggctcacgcctataatctcagcactttgggaggccgaggtgggcggatcaccaggtcaggagattgagaccatcttggctaacacgatgaaaccccgtctctactaaaaatacaaaaaattagccgggcatggtggcgggcacctgtagtcccagctactcgggaggctgaggccggagaatggcgtgaacccgggaggcggagcttgcagtgagcggagatcgcgtcactgcactccagcctgggctacagaataagactctgtgtaaaaaaaaaaaagcaaaaaaaaaaccccccaaaaaaaactagctttaagcaaatcattcattcaataaactttttttttttttttgagtactgctatggaaaaggtgcctcctaaggggctgaggttataaagatgagtactagggagacccatctgctgatgtgtgtatgtttatgtgttagaaaggctggtgtagggatcctggagccagtgggttgcggggcagagggaagatgatgggtgtgtgaactcagaagagactgccacaagctgaggagagctcactttggggctttttgctgatgatagccttgatttttcttctcaagtaaaagagaggatgtttgtgctgaggaaatgttctgaagtcaagtgacagcatgagatttatgatgatgttaaataccttttagctactgatttttgtttttcttttctctatgctacttctctagacatctccttcagtgggaagttcagaagatagtagggcctggaatagaattacttacagaataaatccttacacctcttacactgaggaaaggagaactccctctttgaaacttagtaattatctctccacttcggctgagaaatgtcccagaatagaatcttaccgtccccttgtacattgatgtttcctaagttctagagtaactggcttctttagaacagtagcaggctgcctagcccttgggtgctagctggttctggggtggggcggggtgggggggctgtgggtcctggggtggctctgactgtgaggtctctgtctgaggagggctgcaaggtctgtctgaggtgctgcctccctgactgctgtccccgagtgtcagtgctactgacctcgggtcctaaccttgctctggtttacctgtttgtgactgacccagcttttccaggaccagcccttgcccacccttgtgagctgcagttatgcacatcatggaatgtgtcctgtaggggtcacatggctcccggtcagtgttagactggcacatcttcttccctgtgcttgcttgctcagatgacagtgtacctgcaggcctggcaggggttgtggcaaggaggggccatgggaggctggcccagtggttctctgtgcttgaggtaggtggagaggtttctggttgtcacagtgaccttgggcacagttggcagtaaatgagcaggggcgagggtgcagaacattactctgccgtctctcagggggccctaaggagaaacactgggggccgtgactgagtgggtggtctgtggtctgttggccgatgctctttgcttcctcttaaccaggagtgatactagccccctgaggaactgcatttagcagagagaactggtttagtccccagtcccccagtggtgcctttctgtcagcagtgtcatgtgtgttgcctgatgccatgtggggggtgcccccttttttattttgtaggtacacgaacgaacagaagaaatggatttcctgctattggtagtccgcaaactcttaagaacaaattcacgttttgtgaaggtaaatttgatttcatgagtaacagacatatttaggattaagattcattgtttagttttgtttctctctatagtctgttggtgtctatagagcattctgggaccccggacagatactaaaatctgaggatcctcaagtgccttatatgaaatggcatagtaaagtatttgcatgtagcctatgcacatcttcccatatgctctaagtcacctctaggttatctacaatactgaatataatgtaaatgccatgtaaatagttgctatactctattttttaaatttgtatttttattttttctgaatatttttgattttcagttggttgaatctgcaaatgcagaatctggatacagagggctgactgtattttttttttttgagacggagtctagctctgtcgcccaggctggagtgcagtggcgtgatctcggctcactgcaagctccgcctcctgggttcatgccattctcctgcctcagcctcccaagtagctgggactacaggcacccaccaccaagcccagctaattttttgtatttttagtagaggcggggtttcatcgtgttagccaggatggtcttgatctcctgacctcgtgatccgcccgccttggcctcccaaattgctgggattacaggtgtgagccaccgcgcctggcccagggctgtttgtttgtttgtttacttatttatttattttgagatggagtctcactctgttgcccagggtggagtgcagtggtgcgatctcagctcactgccacctccgcctcccaggttcaagcaattctcatgcctcagcctcttgagtagctgggactacaggcacccaccaccatgccaggctaattttttttttgtagtttttggtatagatggggttttgcaccaggctggtcttgaactcctgacctcaactgatttgcttgctttggtcttccaaagggctgtgattacagatgtgagccactgcacttggccgggctgactgtattttaacagaaacatttgaaactgatgacgcttaaaattcatgatcatgtgtagtacaccagatcttgccaggaagccaactaaggggcattcttttatgaacagagtacggatactttttggttattatgttgccttaaactctcatattttctccaggctgcagaaaatggtctagttgactataatgacatgctgggttttgagctttgcttttggttgaataagtaccacagtttaaaggtatgtgaatgaagctgggtggtacagtggctcacgcctgtaatcccagcagtttggggggcaaaggtgggcagattgcttgagcccaaggagatcaagaccagcctgggcaacatggtgaaaccccatctctacaaaaaatacaaaaactagctggacatagtggtgtgtgtctgtggtcccagctacttgggaggctgacggaggattgcttgagcctgggaggtccaggctgcagtgaactgtgattgcgccactgcactccagcctgggtaacagatgagaccctgtctcaagaattagccgggcgtggtggcgggcgcctgtaatcccagctacttgggaggctgaggcaggagaattgcttgaagccgggaagcggaggttgcagtgagccgagattgtgccactgcactccagcctgggcaacagagagagactgcatttaaaaaaaaaaacaaaaacaaaacaaaaagtaagtgaatgaatctgcagtccctgtgttcgaaatagcaccaaagtgcattgaaatttgagaacagagtatgtactagtatttgagagacgtaagtagagttaactgaaagttgatgggaatgataaatatcatttacttcttatttgaacaaaaaggaagaaggtgtgaactaggccaaaatggcgaagggtttagaataattgtgcagtctaaataagtctactcataggtcgaccttaacccagctgtgctaagcagaggtctgtgggaaacagcttgataaaaggccgcatggttgggttattcagttattctatgatggggctgctttggaaagcagttgctttctaaaccataaagcattttgtcttcaagtgtttatttgttgaggaaaacatttctctttctctttcccatgtccccaggtggggaagcttctgccttaggatgttcatattttcactgggtgggtgctgaatgaatggaactcgacacttgcaatcagttgtcttattgcttgaggtgactatgaaatgaatgagagaatttggctatttcagtcctttttggaatcttaaccaagctgccattgaagattattcacattgagacctttcttgaatgtcatttaagactcttcttttttactcaagtcagaataatgagttggttacacattttttagttttcaatggtaaaaagagttagacaagtgttagtggattaacaaaaccctacactgatggacatgttggtaaggaatttggtacttataagttgtaagatatggttggtcagtttcactgtgttcatgatttattaacaaatacgtgaagcagcatattttctcgatatagaaacttatatggtacatgtagttgggccaagaaattagacaccatattctaggtggttttgtaagaggtttttaaaaaactctcaaaaaatctgtatcagcttttaaagagagtgccgctgtcaagaggacctgggtgtggggcacgggcacatgggctttaaggcctcccctttcctctccccccaacctttaggtccctgtggttcccccgacctggcttcctctcactgcctcctctataccatcctccagccactgaccttgttgtcacctcttgctgactggactcagctcaggcccactccagacaggcagttgtcttgggtgtctgctgacttgcctgtttggagaagaggcagagggctgccggggagggtggatgagggaggctggtggccaggctgagtcctgcttgctccctgcattccaggcttggcctcttgtttgcaggctgcactctgtgtcctgcagttcactggcctcgtcgttccttaaaacccagtttagagatcatttatggtgactggggtgtgtcccttaggagcctctcttccactccaagtggcttctgagagcattctttttaacttcagacatctcaaaatgagttttagtctgtacagtttttaccatttgtatctcattccaaaggggaaaatacagatgttttctttactcaataactgcaacaacaatgcttatatgaaatgtttactttttggctgggtgtggtggctcatgcctgtaatcccagcactttgggaggccgaggtgggcagatcgcctgagctcacaagtgtgagactggcctgggcaacatggcgaaaccctgcctctacaaaaaacagtcacaaaaattagccaggtgtggtggtgcacacatgtagtcctacctacctcagaggctgaggtgagaggatcactgaagcccaggaggctgaggttgcagtgagctgacatcacaccactgcactccagcctgggtggtagagccagaacttgtctcaaaaataaaaaagtttactttttggctaggatttcctcttagatacctctacttgcgatgtacagtaggtggtgagcagccagccggactgctgtgcccactccccacgtagcattatggagactgctgagctgggagaccctccataatcagccactttctcctggcacgtctcgggctgtatgcactgctcctgtcattcatggctgagtttcttaaggatatcatttcatatttgctttttgacaaaactggaagctgcagtcagtcatcttgccccagtctggggttgttcctctgctcctgcaccactgtcgtcctgggacttctccagtttcttgagttggagctagagttttctagatcccgttttctttgctggcttactctgtcatttctctggaacacatcatagagtaacttattctttttaatttattttttatttttgtttttagaaacaggatcttgctctgttgcccaggctagagtgcagtggtgtgatcatagatcactgcagcctcgacctccttggctccagtgatcctcccacctcagcctcttgagtagctgggactacaagagggcaccatcatgcccagctatttttaaattttttgtaatgatggggtcttgctatgttgcccaggctggttttaaactcttggcccaagattacaggcatgagccacggcacctggccttactctttttttaaaatttatttttaattaattaatttatttttttgtagagacagtggtctcatgttgttgctcaggctggtcttgtactcctgggctcaagtggtcctcctgcctcagcctcccaaagtgctgggattataggtgtgagccacagtatctttgtttacctgggccttattcttttttaaaattagtctcctgatgcaaagttttctttcagaaaaatggttttaatttacccttattggagatgaaatttatcatttgaaaaggtactcgaagagaaatagtaaaagttggtatctctgaacattgtttaaactacaataattacactagagattaaatcagggtggtctgtttaaagtctcaaaagttgttagataaggagtgaagcagaagaaaagcctgcagttttagaagtatttaatttgtgatgattctcattgttttatttgaatgttttctcttactctgtaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaaggtatgttagaatgtgctgtttcttttatagtgagcgtactcttgtattggatcaaacctgcattcatcacctatgattgtaaggccctgcgagaaaattattattttaaaattgatgcatactaagtgtacatatttatggagtatagtgtggtattttgatacataggtataatgtgtcatgatcaagtcaaggtaattagcaaatccatcatctccaacatttatcattgttaattatctttaacatttatctttgtggtgggaacatttaaaatcctctcttctagctatttgaaaataaacgataagtttttgtcaactgtagtcaccccacggtgctctagaacacgaaaactgggcgtagtggtgggggtctgtagttccagccatagtgggaccctcatctctctttaaaaaggacactagaagttatttcttatctagctataattttctgtccattaaccaacctcttcctatttcccccccttcccagcctctagtaacttcttttctactttctccttccgtgagatcagccttcttagcgtccaaatttgaatgagaatgtgtggtatttatctttctgtgcctgacttatttcactaacttcactcagccatgttgcccagaatgataggattttattcttttttcatggctgagtagtatttaattgtgtgtatatactatattttctttatccattcatctcttttttttctttttttttttcgagacagagtcttgctctgttgcctaggctggagtgcagtggcgcgatctcagctcactgcaagctctgccttccaggttcacaccattctcctgcctcagcctcccaaatagctaggactacaggcgtccgccaccatgcctggctaattttttgtatttttagtagagacggggtttcactgtggtctcaatcccctgacctcatgatccgcccgcctcagcctcccaaagtgctgggattacaggcatgagccaccgcgcctggcctatccattcatctcttaatgtacacctaggttgattccatatcttggctatggtgaataatgctgcagtaaacgtgagagtggagctatctcttcagcatattgtttttctttcctttggaaatatacccagtagtaggatggctaggccatatggtagttctgtttttagtttttttgaggatcctccatactgttttccataaacgctatactaattgacattcctaccaacagtatacaagagttcccctttctttgcatttttgccagcatttgtcatattttgtcttttatttttacttatttattttagagatagggttttgctctgtcacccaggctggagtgcagtggcactatcatagttcactgaaaccttgaagtcctgggctcaagcggtcctcctgcctcagcctcccaaagtgctgggattacatgtgtgaatcactgcacccagcctttatttgtcttttgataatagctattctggcacatgtgagataatatctcaatatggtttggatttgcatttccgtgacaattggtgatactgagcattttttcctgtattagccagtagtatgccttctgtttagaaaagtcttttcagctcacttatttgcccattaaaaaaattggattgtttgggcctggcgcggtggcttatgtctgtaatcccagcactttgggaggccgaggccggtggatcaccaggtcaggagatcgagaccatcctggctaacacggtgaaaccccgtctctactaaaaataaccaaaaaattagccgggcgtggcggcaggtgcctgtagtcccagctactcgggaagctgaggcaggagaatggcatgaacccgggaggcggagcttgcagtgagccaagattgcaccactgcactccagcctgggtgacagagagagactccatctcaaaaaaaaaaaaaaaaaaaaaaaaaaaaaaattggattgttttttgctgttgagctccttgtatattctgggtattaatcccttgtcagatgaatagtttgcaaatgtttccccccattcactcagttgatttctttctttttttttttttttttgctatgcagaagcttgttagtttgatataatcctatttgtctacttttgcttttgctgtctgtgcttttgaggtcttagccatcaaatctttgtacaaatatatgtcctgaagcattttccctatgttttctgctaatagcttcatagtttcaggatttagtttaagtcttaaatccattttgagttgatttttgtgtatattgagagagaggggtttagttttatttttctgcatctggatatccagtgttcccagcaccatttattgaagagactgttctttctccagtgaatgttcttgatgcctttcttaaaaatcagttggctgtaaatatgttattttatttctgggttctttattctgttccattgatcatctgtgtgtctgtttttatgccaatatcatgctgttttggttaccattgctttgtagtatattttgaagttaggtaatgtgatgcctcttgctttgttcactttgcccaggattgctttggcttgtgagatcttttttggttccatatgaattttaggattttttttttgatttctgtgaagaatgtcattggtattttgattgaaattgtatgaatctgtacatcactttgggtagtatagtcattttaatagtataaattcttccaattcatggcaaggcacagtggctcacacctgtaatctcagcactttgggaggccaaggtgggccgatcacttgagcccaggagtttgagaaagaaagcatagggaaaatgcttcaggacatctatttgtagttaacatttacttagtaacacttaaaaaaacctactaactaaacttcactttatttggtttgactgtattttccataatgtcctttattctgggatcccgtccgggatgctacattaggtttggtcgcgatgtttccttaggctcctcttggctgtggtagtttctcagactttcctcattttttaagactttgacgatttgaagagtactggtctttgactgatgtttttctcatggttaaactgaggttattggttttggggaggaagaccacaggctgaggtgccatttttgtcacatatcaagggtatacactatcaacatgacctttactggttgtcttaagtctgtttaatgttttttttaattaaaaaatttaaattcacacataataattcatggggtacatagtgatgtgatacatacaatgcatggtgatgagctcagtgtaactagcatatctattgtatcaaacatttttttgtgtgtgtgttgggaacattcagtagcctcctatagctatttgaaattacatattgttgttatctgtagaacactggagcttcctcctcctatctggctgtccttttgtatcctttaacaaatctccctattgcctcctcctttcccctacccttcccagcctctagtatcttctgctctactctttacttctattaaactgttttttagcttccacatgagaacatgtggtatttaactttctgttcctggcttatttcacttaacataatgtcctccagtttcatccatgttgttgcaaatgacaggatttcacagtttttatggctgaataatactccattgtgtatatattctccattttctttctccatctgttgtacacctaggttgattccatatcttggctattgtgaatagcatttaacactgttatgaaggaatacctcagtctgggtaatttataaaagaaagaggtttatttggctcacagttctgcaggctatacaagaaccatggcactggcctctgctcagggagctggtgtgtgcagagatcacatggtgagactggaagaaggtgggtgtgccaggctttttgtaacagtcacctctcagggggaactctggtaggaaccaataacagtgagaactcagtctccccaagggagggcattaatctattcatgaggcatccgcccccatgtcccacacacctgctattaggccccacctccaacactggaatcaaatgtcaacatgagatttggaggggacaaactatagcactgatgacacagactttgatcactggaaaggttgtgtttgccaggtttctccattatgcattactgcctcctttccacattgtactcttgagaaacaagttgccaggtgaggctctattcaaggtagggaggaggtagcacttacatttacaacatttaaacaatttgcattttctgactcttttttttttttttctttgagattgggtcttgctctgttacctaggccggagtgcattggtgcgatcatagctcactgtaaccttgaactccttggctcaagagattctcccatctcagccttccaagaagctatgactacagatgcataccaccatgcttggctaattaaaaaaaatttttttgtggagatagggtcttgctatgttgtccaggctgatcttgaactcctgtctgtagggaccagccccacagggtcggtgggtttttctccccgtgtgcagagatgagagattgtagaaataaagacacaagacaaagagataaaagaaaagacagctgggcctgggggaccactaccaccaagacgcagagaccagtagtggccccgaatgccaggctgcgctgatatttattggatacaagacaaaggggcagggtaaggagtgtgagccatctccaatgataggtaaggtcatgtgggtcacgtgtcgactggacagggggcccttccctgcctggcagccaaggcagagagagagaggagagagagagggagagacagcttatgctattatttctgcttatcagagacttttagtactttcactaacttgccactgctatctaaaaggcagagccaggtgtacaggatggaacatgaaagcagactaggagtgtgaccactgaagcacagcatcacagggagacggttaggcctccggataactgcgggcgggcctaactgatgtcaagccctccacaagaggtggaggagcagagtcttctctaaactaccccagggaaagggagactccctttcccggtctgctgagtagcgggtgtttttccttgacactgacgctaccactagaccacggctagaccatggtccgcttggcaacgggcgtcttcccagatgctggcattactgctagaccaaggagccctctggtggccctgtccgggcataacagaaggctcgcactcttgtcttctggtcacttctcactatgtcccctcagctcctgtctctgtatggcctggtttttcctaggttatgattgtagagcgagaattattataatattggaataaagagtaattactacaaactaatgattaatgatattcatacataatcatatctaagatctatatctagtataactattcttattttatatattttattatactggaacagctcgtgccctcggtctcttgcctcggcacctgggtggcttgccgcccacacctgtcctcaagtgatcctcttgctttggtctcctaaagtgctgggattacaggcatgagccatcatgcctggcctctgactagtttgaaatgtgagagtgatgatggtttaccagtcttctttccagctggctgaagtctaattaattcctattgatgttcattgtgtattttctgtcagagctcacaacacttagatgcttccttgtggacccgctgaggagctggatcaggccttgccacttgctgtctgagcccgtgtggtcaagacaacccagcttctaggcacccagggcccccttgcctcatgggtgggttatgttcaatagaatagagaatgtccagctttagcaagatttatccaacgtcttgtttttggtacctgataggtgctcagtaaatatttcagtgaatgaatatgcaacacttagctgtatacagatgttccttgacttgtaatggggttatgccctgataaaaccattgtgagttgaaatcattaagttgaaaatgcatttaatacacctgtcctcctagcctaccttgaatgagttcagaacacttatttagcctatagttgggcaaaatcaccaaatacaaggcctattttataataaagtgttgaatatcttatgtaacttattgaatactgcactaaaagtaaaaagcagagtggtttcatatcactgtaaagtctaaaaatataagttaaatcattgtaaatcagggacagtctgtgttaattttgagcttataaaaatggtgttgttttgtatagatcctattatacagcttcagaatcagaggaccttggttaaaatttcagttgtgttactgtcagtactcttgtcatgttacctcaccacactgtctgctgttacaagggagacttgtcatgttacctcaccacactgtctgctgttacaagggagaagccccctttcttcatggagcaccagccgcgcctcctgggtttcatgtctcatccttcttaccttcttagggacctcatctgatctactgtttccccctccccattgtcaccattagtgtctccttctctgctgtcattttcttgtccacactgaaacataactgaagctctttcacctttgcgaacacccaccttaggtctcaggctgctctccagccgttgctggcctgtggactctctcattctctacttttctacctcccgcaggcaattcatttattgcagggtggtgtcccctgttgccactcagactgcacctgccagggtccctagtgacctccttgtcgttaggagagctctaggtaagtcctagacttacctggcctttctgcaatatttgacactgttggccacttcgattcttgaaactcaccctctctttgggttctgtggtggcatcctggtttttctgttaccagatctggctgttccctttcagtgtcctttggagagtccttttcatcctttatattcagcttcttaaaaaattgtgaaagaggccaggcgtggtggctcatgcctgtaatcccagcactttgggaggccgaggcaggcggatcacctgaggttgggtgttcgagaccagcctaacacggagaaaccccaactctactaaaaatacaaaattagccaggtgtggtggcacacgcctgtaatcccagctactcaggaggctgaggcaggagaattgcttgaatccaggcggtagaggttgcggtgagccaagatcacgcccttgcactccagcctggacaacaagagcgaaactccgtttcaaaaaacaaaacaaaacaaaattataaagaacacacttagaaaaagggttacataaaatgtaaatgtgtactgtaatgaaattgtgaaatgatcaacaacccaggtccagtagtagagcatgccccccgccccacctggactcgctgtgggtcactttttttttttttttttttttttttgagacagagccttgttctgtcatccaggctggagtgcagtggcgcgatctcagctcattgtaacctctgcctcccaggattgagtgattttcctgcctcagtctcccgagtagctgggattacaggtgtgtgccccatgcccggttaatttttgtatttttagtagagatggggtttcaccatgttggccaggctggtcttgaactcctgacctcaaatgatccacccggctcgacctcccaaagtgctaggattacaggcatgagccaccgtgcccagcctaaaagtcaacttttataaattatttggaaactagctgacttaatttactctaagtaaaaattggaaaaaaaatttgcccctgtgattggcttctctgatcacctgaagacttcttttgatttgtcctcaacaaaatcagatgcaatattctgcacatagtgtttaacaagtaaaattattaattaaaaaagcttcttactctgggtgaaaaaaacccagtatcgctataaaatagatttttcagaaatttagagacatctgttgtgctggatactgtagaaagatgcttgtgtagttgtggcctcagcttggggaaagctgggcagtcacacccatagtaaattagtaccagtagagtggggcactgctgaaaagatacccaaaaatgtggaagccactttggaactgagtaacaaggcagaggatggaacagtttggagggcctagaaggagacaggaaaatgtgggaaagtttggaacttcctagagacttgttgaatggctttgaacaaaatgctgatagtgatatggagaatgaaatccaggctgaggtggtttcagatggagatgaggaacttgttggggactggagtaaaggtgactcttgttatgttttagcaaagagactggtggcattttgccctgccctagagatttgtggaagtttgaacttgaacgagatgatttagagtatctggtggaagaaatttctaagcagcaaggcattcaagaggtgtcttggatgctgttaaaggcattcagttttaaaagggaaacagagcataaaagtttggaaaatttgcagcctgacaatgcaatagaaaagaaaatcccattttctgaggagaagttcaagtcagctgcataaatttgcataagtagtgaggagctaaatgttaatctccaagacaatggggaaaatgtctccagggcatgtcagaggtcttcacggcagcccctcacatcacaggcctggaggcctaggaggaaaaagtggtttcgtgggccaggcttagggcccccgtgctgtgtgcagcctagggacttggtgccctgtgtcccagccgctccagttatggctgaaagaggccaacaaagagctcatgccgtgtcttcagagggtgcaagcctcaagccttggcagcccccacatgttgttaagcctgtgggtgcacagaagtcaagaattggggtttgggaacctctgcctacttttcagagaatgtgtagaaatgcctggatgtcagggtagaagtttgctgcaggggcggagctctcatggagaacctctgctagggcagagcagaaggaaatgtggggttcaggcctccacacagactccaactggggcaccacctaatggagctgtgagaagagggccattgtcttccagaccccagaatgatagatccaccgacagcttgtaccacgcacctggaaaagctacagacattcaatgccagcccatgaaagcagctgggagggaggctgtactctgcaaagccacaggggtggagcttcccaagaccatgggaacccagctcttgcatcagtgtgacttggatgtgagacatagagtcaaagatcattttggagctttaagatttgactgccctgctggatttcagacttgcttgggacctgtagcccctttattttggccaatttctcccatttggaaaggctatatttacccaatacctgtacccccattgtatctaggaagtaactaatttgctttgagacttgggactatggacttttgagttaatgctgaaatgagttaagactttgtggggactgttgggaaggcatgattgtgtttttaaatgtgaggacatgagatttgggaggggccagaggcagaatgatatggtttagctgtgtccccaccgaaatctcattttgaaatctcacctgttatgggagggacccagtgggaggtaattgaatcatgggggtaggtccttcctgtgctgttcttatgatagtgagtaagtctcatgaaatccgatggttctgtaagggagagtttccatgcacaagctctctctgtcttccaccatgattgtgaggcttccccagccatgtggaactgtaagtccagtaaacctctttcttttgtaaattgcccagtcttgggtatgtctttatcagcagcatgaagatggactaatgcacagcctgacttggggagtttgccgcttgtggttggtgcctagtgtttggtagcggtgcctgaggggcaagtttacattatctggtcttggtgtctttgctttaatagacaattaaaagtagtagaggaacccgtaaaccttggtagacggatacctcatcatgaggttatgttatcaccacacattggtagatacggatgtgacgttacagttttctggtacttttgatatacaaggttacttttcacacgtgaaatcttagggaagtcttagggctctttgaggtgggggtttgacagaggggaagggcattggctttgagatcaggaactcctcctgggttccatagacatttggtgtgacttaatcgatgtcttcaaagtagacatcctgccaaacacactgcctgtgcatgtctgggctctctgagccattcttgctctggtgactaggcgaggagattgatgagtatggcactttatgtgtccactgtcctgagcagtacttggcacacagcacgtgttcagacattgctgtcaataaaaaccaagaacttttatttagagagtttgttacagtgttgtactaatggtgagagccagtcccatccaacgccaggtttcttctgtaatcctgttttcgtattgcgacttttttctttcactgtttttagctctctcctcatctcctggaggaaccggtgataactaaggatatatatgaagttgctgtctctctcattcagatgtttgatgacttggatatgaaggagagtgggtaagagatacttcagttggtaatgcactttaatgtatatgtgatttaaaaaattattcatttggaaacgttttagtgtttttataagaaggtataactataggtacttttttagtagttactgtatatattttaaaatcaggttagtattttggaatttttttaactggaaatatctattttaaataattaaagccatgctgagtgcagtgttaggactgatagttttaaaagctaggatttatagcctgaaaatagtttttccagacatataggggtcttatcactcttaatgctggggtaaaactttaaatcctacattagtagaaactgttgaaactttctttgcatttgttttcatttactataaagacatattcttgaccctaagcaatctccttctgtaatccagatgttcattcatttagctggttctttgaaaattggaacattttccctgaggaacagttttaggttataagtggtgactagagtttataattttaaaaatatggctgggcgcggtggctcatgcctgtaatcccagcactttgggaggccgaggtcgggggatcacaaggtcaggagatcaaaaccatcctggccaacatggtgaaaccctgtctctactaaaatacaaaaaattagctgggcatggtggtgcgcacctgtagtcccagctactctggaggctgaggcagaggaatcgcttgaacctgggaggcagaggttgcagtaagctgagatcgtgccactgcactccagcctggtgacagagcaagactccatctcaaaaaatatatacacacacacacacacacacacacacacacacacacacaccatatgattgagcctttacagcactaattttactacatctgtctccatagttttgccttttccaggatgtcatgtagttgggaattatacagtatgtatccttttcatgttgtcttcttctacttagtaatatgtatttagttccccttatgtcttttcatggcttagatagctcatttctttttagcgctaaattccattgtctggatgtaccttgttcattcatcttccaaatttcctgctatgttctgctttagctgtgtcccattagttctgctatgttgtgtcttcattttcattcatctcagagtattttctgatttccattttgattttttctttggcttattggtttttaggagtgtgttgtttaatttgcacatatttgtgaatttcccccaatttttcctgttacacattttgaatttcattctattgtggttggagaacatattttatattttttctgttcttttaaatttatggaggtttgttgcatgcctagcatgtagactgttctggagaatattacacgtgcacttgagaataatgtcactcattgtttttagatggagtgttctatagatgtcttttaggtatggttgacttaccatattgttcaggtcttctacttcttgatcttctgcctggttgctctatatattatcgaaaatgagatattgatgtcctcagcagttgttattgaattgcctatttcttcaatcttttctgtcagtttttgctttatgtattttggttctctgttgctagatgcatatatgtttatacctgttacatcttcctgattgattcacccatttatcattataaaatgcacctcttatctctcgtaacacttaattttaagacctattttgtgtattagtatagccatttcacttttctgtagttgctgtttgcatgacacatattttttcattcttttactttcagtctacttagtgtctttgcatttaaagtgtatctcctgtagacaacatattctgagtgggatattttttttttttaaagattgagtcttgctctgtcaccaggctggagtgcagtggtgtgatctcagctcactgcaacctctgcctcctgggttcaagcgattctcctgtctcagcctcccgaatagctgggactacaggcatgtgtcgccatgtccagctaatttttgtatttttagtagagacagggtttcaccatgttggccaggatggtcttgatctcttgacctcgtgatgcgcccgcctcggcctcccaaagtgctgggattataggtgtgacaccgcgcctggcctgtatttttaaaattagtctaacaatctctgccttttgattgggctgtttaatccatttatgttgtttaatccatttacatttaattttgtcactgatatagttgaatttatgttggccattttgctttttgctttctggatgtctcatattctttttgttcctctgtttctcttttactgctttcttttgcatttaacacatattttgcagtgtagcattttactttttttttttttttttgagacaaggtctcactgtgttgagcaggctgggtacagtggagtgatcatggctcacagcagcctcgacctcattggctcaattgatcctcccacctcagccttgtgagtagctgggacttagaggtgcgtgccaccacaccctgctgatttttgtatccggttacttttaaaatcacctaagaaggaaggaggcaaaatatgtatttacagtatcttttgttattaactaattacctttaccagttctctttctttgttcatgtggatttgaaatactctctggggtcggctgttttcagcacaaaaaaacttcctttagtatttctagtaaggtgggtctgctagatactctcatttttttatctgggacagtctttatttagtcttcattattgagagttttactgaatacaggaatcttgatcgacagttgttttctctttgagcactttgaatatgtcatcccactgctttctggcttccattgtttcttctgagaattcagctgttaatcttactggggttttctttgcatgtggcatgtcattatcctcttgctgcttgcaagatttcaccttgtctttgaatttcattatggcttttatgacttcctgtaggactgggacaataattgagcctttaataggcattttcatctttcttttaagccacctgcttttggatgcatggtaataccattgaatttcatgagtccattgactactaaactgagctccttggcaggaggccatgctgtgcaggaaataatggaagcgagaaaggcatctttaggtccatggatgggggtatgacaggagctttaggtgcagagaaggcagacctgaatccagaataggatctgtatctatttccatgagggcaaatcagtatctttttcatgatggaatcaacctgtcatcagctggctgggctggtcccccagggaatggtgccatatttgggacttggcactggcccttgctgttgtgtggttggcatccagcagtggtagcagccggatgagtctcatctcaggaaagtgcatggtgttgagtttgtgtgtaagccttcatccctgctacctgtccactctgtgcgttttccaaccctggagggactggagaaggaggctgggtcacgtccacaggcagggcctcttgcccgtctggtgactgaaagccttctccactgtggctgccttatgggcatttcttggtacctctccatcagatctccttattatcagtcttgccatttccacatccctgaccagctgaccaagctattagcctctgcctattgattggggtgaacccaacctcatggccatgtctccttccacccaaagcggtaccaccagatggacggcctcacctctgctaactgggaagagctcccttccccactcactgtgtgtgagcctctcctctgggtggggctgtgatgcagcagatgttcgcccctggttgttgccagcatcccatgcaggcccatctacaaaccaaggctgtgtttttcatggtagtggctgccgcctgaggtcataggtgtggctcaccctcatagggagagatggaggagcagcaggagcagtgaccatggatgctgagctgcctgtgctgcagtgactggtttacccctcacacccctttctcctttgtagtgactgttcccaggcattgcctggattgccactgcatggcttttccatggctccctcctcacctcccattacttccccagagaggcccttcccagccagccctcctgagagcactccatacatgcacctcccttagcactgcttactgtgtttccctgtgtgtctctttaggtcttattgctaaattgaaggtgccttgtctgttttcttgtttcctgtctgtctctccagttagaatgtaagctccaaagagcaaggagcttgtcttcttgttactgctgtatcttacacagaggagggcctggcatgtaggaagggctcacaggttcatggaagaatgaaagttctaaattcacacaaaagtaaatatattgacaatagcaaggaggcaagtagatgatttgagattttggtctgtacaaatcctttctaatagtttggactcatgaacatttaaattttgcttgtagttattttaaatgttttttactttgaagttcttgattacaataactaaatttcaaggaaaacttctgcagatagtaagttttgataggagaaagtattgggagtcaaaaggcttaagtcccctgaatgaccatggggccttggatgttttctcatctttttgggcttcgtgttttcttatgtaaaataaggaacattacattggatgacctgtaagagcctttcaggattaaaagcctgtaatattaggattttagagaagcaatagctgttattagccttcattaatatttgtgcacatcacatttttaacaggaacaaggcttggtcgggggcccagtttgtgttggagcgaagcagtgtgttggtgtttttgccaggtaagaacatcataattttgtgacttggaatcataatactctggagagaggctaagtttgtgcctaacacagattatgaaagatggtattctccataggactttattctttttacactttgagtatgtgaacaaatgtaactttcagtttggctttttattgtaacccttgcatttcttttttttttccttttccttttcctttttctagatggagtcttgctctgttgctaggctggagtgcagtggcacgatcttggctcactgcaacctctgcctccccggttccagtgattctcctgcctcagcttcccgagtagctgggactacaggtgcacgccaccacgcccggcttatttttgtatttttagtagagatgagctttcaccatgttggccaggatggtctcgatctcttgaccttgtgatctgcccgctgtggcctcccaaagtgctggaattacagatgtgagccactgtgcccggccaacccttgtatttctaaaaaagatttcttattaataattaagagttcaatttttttttttttttggagacagagtctcactctgttgcccaggcaggggtacagtggcaaaatcttagctcactgcaacctctgcctcctgggttcaagtgattctcctgcctaagcctccgaagtagctgggattacagacacgcgccaccatgcttgtctagagttcagctttttgaaggcagttttgccaccttcgaaatttccagtaaaatatttggctttgtgaaatttgcattttacatatgtcgttataaatgtgaggtaactgtcatcagtttgcattgaaagcttatttagtaatagtaaaacacactgttattataacaccgtgagaatcatcagggtaatccttgagttcccttctcagtgtttgagaaaacagacttttaaaatacctttctgaaaagatgaatttatgttaaattgtactttttcaaaattacttgatgtttaattcaagtggtatagcttgatgaaacattatgacaataattcaaatattttctgttgtaatatatagagcataaacagatttgttcttaaaataatggagaatgaaaaacatgcaatgaaagtagcttacttaattttggaatgcaacatatgagtttcaaacttttgtcatgttttgcttagctgataaggatttgtttacatgcagggaacaaccatgagctgacagtggggtggtgttgcatgtgccttggtgaatatttatcagatgacttctgtgtgcatcatattgtattaaggggaaaacatcacccaagtagagccatgttgatactggcttaagaacacctaacatgggccgggcacagtgctcacgcctggaatcccagcactttgggaggccgaggcttaagaacacctaacacggacgggcgtgggggctcatgcctggaatcccagcactttgggaggctgaggtgggtggatcacgaggtcaggagatcgagaccatcctggctaacatggtgaaacctcatctttactgaaaatacaaaaaaaattagccgggcatggtggcgggcacctgtggtcccagctattcggaaggctgaggcaggagaatggcatgaacctgggaggcggagcttgcagtgagccgagatcacgccactgcactccagcctgggagaaagagcgagactccatctcaaaaaaaaaaaaaaaaaaaaagaatacctaacatgagataaatactctattttatttattttttaagaaagggtcttgctgtgttccccaggctggagtacagtggtgtgaccccgatcactgcagcctctaccttctgggctgaagtgatatttccacctcagcctcccaagtagctgggactgcaggcatgcacccccatgcctggccaaatttttttttttttggtatctttttgtggagacggtttaactagcttgcacaggctagtctcgaactgctaggctcaagtgatctccatgaagtgatccacctgcctcagcctcccaaagtgttgggattgcaggtgtgagccactgctcctggctggtaaatactttttacctgctaaacattgcctgaagaaaatatttataagtgatattttacatttagggttactgtccttttaatatgttcatgtgaattcaagtttgatagatgtttatgtgtcaattgatcttttgtgaacagttctatagtagttttccaggactgctgtaacaaagtgccacaagctaaatgccttaaaagaacagtcatttattctctccctgttttggaggctagatgttcaaaatcgagttgtcagcagggccatgctctttctgagcctcttcctctttccagctcctggtagtggccgtcagtccctagtgctccttgacctgtggctacatcactcctgtctctgttgtcacatggcattctctgtttgtgcctcttcccttcttgtatggataccagtcattttggattaagggctcaccccattccagtataacttcatcttaactaattacatctgcaatgactctatttccaaataacaccaccttccgcattctggggttaggacttcaatacgtctttttaggggacacagttcaacccataacagactcagatttgagaatcaggatgaggcaaaagcacctgctagcttagctttcagcaaacaggacggaggcctgatggaaatggtttagcacatcctcatgaccaaaactttacaaatgttattttttgattgtaaagattttgcatgctcattatagaaaatttagaaaatctgggggtaaaaaaggaatacaaaaattactcatatagctaacacccacagggagtcactgctgtgtaaaggaaaactggaataatagggtttttccctatatttttgagttactactaatcaatgtcactgtgtacttttacttgtgtttctggcatatttaggcaaagaggataaagaagtcaaataaattggtagggccttctttgaaagatatgccattttaatttaaaggttggtttctagcagtaaatacaaacatgtttatttccctcctccacttttttcttccctaggtctgggtgaaataaattatatgcatgaacttctcacaagcctggttcataaaaggtatgttgaaaatgatacagctgtattcttctaagccattgcattgtttctgccttaaattatctcagtatttatttttgtatctcatgtatatctattctttatggagattttattttagtaatttcttaggttgcaggtctatccactccattcaagtgtggctttagaagaacagaataatgtctttttaagtccagtccctgggtacagaaaggtaggaaaactgggaagacaagttctaagcactttaggtaaattttccttagagactctactcatgaaaaatattttctgggtgtcgtggctcatgcgtgtgtttccagcactgtgagaggctgaggtgggtgaatcatttgagctcaggaatttgagaccagcctcatggcgaaaccccatctctacaaaaaatataaaaattacctgagtgcagtggcatgcacctgtagtcccagctacttgggaggctgaggtgggagacttgtgcctgggaggtggaggctgcagtgacccgagatcacactggtgcactccagcctgggtgacagaacaagactgtctcaaaacaaaaaaaaaaaagaaaaaaaaatcacatttcagcagtgtgttctgtagttagtggttactcacttaaacaaatatttacctaatgagccaggtatgttgtttagttttgtgttttattttgtaaatcagtttgctaaaaagctaagattttttgttttctcaattcaggaattctggtgccttttaattcttctttagcatttctttaactttgggactgttctcgtgtccttgaaaccactctggtgactctggttagaagccatattctaggtcctgcttcaggaggatttctttatctcagattatgtgtgaatgatggagttgttttaacaagacccttctagagctgcttgaggtgatcagggggcctgagttgacaacgtcgccccccttgattgctttggaatctctaggagcagccttgggtggtattctagggcaagtacaggcaacaacccttcttctagaaacctggttgtgcccctgggcaattccaggacccctctccaccccaccaaagttaccacaccagaagtcaggaatagctccctttgcccgtgtcttgtctgcctgtgttaaagcctttgctgtgttgtatgtggctggtttccattcatcaggggcttcttgatcaattgtgatgtgtataaaatagaaaaatggctaattttgaaacctgagttcagtatttacattcagaagctttaaaataatttttgcatttttgtaaactttgcctaatgatgttcggaatatagtaggaatgtcagcttttttctttgatgtttaacagattattctgtccaccaatattgcagagagttctgtcacagttccagatgtcaaatatggtaagatacttctccgtttacctcctggcattagctgtagtgccatatttattggcttattcacctcactcaggaattgttcttctcttccttcccatctcctcccgttttggaacacagaattgagaaaagtaggtttacgtagtttctcccatactctcagttcaccaccacctcctctgagtgtacctgtttcatcctttagggcaagctggctcgtcggaagtgtttggggtgttccactgggccttgtgggaaacagcttcggggctgccaggtggagttctgtgactggagggaggcagatgtggggaggagctcaggccatctcagctctgaaggttgcttggcaggacaccatgtcaactctggagcagcccactttgtcatctcatcttccacatatgtgtctgtaattactttgtgagattgcttcatcaatgagttttctaaattcattaatttatatttgaaaacctaacacatgtgtcgggcactgttctcagtgctggcagtacagtggtgagtaagacaaagtccagtcctcatggctgctacgttctggtgggagagagagatgcttagcaggtaaaaaggttttataatttcaggtacaggtcaatgttgtgtaggaaaataaatcaggggaaggggtacagttattgggaaaaatgatctttcagataggatctttcagataggaattacctctttgaggaagtgacattttaatagagacctggattaaatgaggagcgagctatgcaaaaaggtggctggggtgtagggaacgggtttgaggagcagcacacggccagtgtggctggaatgggtaaaccagggcagatgataatgagcaggtgttttgtctttgtaccagcgaaatagcagtaagcaaaatagacaaaaagcctttgttctcatgacacattcggggtgggtagataagtacagatatggagtaagttacatgatggtgagtgtatgaagaaaaaggggttattgggtagggagtgtcagggaagcaccattgagattgcaggtggagtgatcagggaatgtgacaagtcacatcctgaaggaggttagggagggagtcgggtccatacctggcaaaagagtgtttggggtaggagaaggcaagagtgtgcttgatggttgtgaaacagcaccatcaagcaaggaggccagggcagctggaccagtgtgaacgaaggggaaacgagccagaagagaggcctgggggtagcaggggccatgcagggcccataggacctggtacaaccttgctgtgctgggcaagatggaaaatcgttggtaggttttgaaaacagaaatgacataacctgaagttcacttaacaggatttctctgggaatagactagaatgaggcaaaggagagaaaaggaagagacttaggagggtgtcacaagaatctaggcgacaatgggtggtgcttagaaaaggacagcagcggtaggggacaggaggtgggggtagatcccagggagattctgaaggcagagctggggaggatgtgctgaggtctctgatggagaaattgtgagagacacatttggtcggcctctagacatgtggcctgagagactgggaggatggaggctcctgcgagatggtgaaggctgtggaaggagcagggtggggcaggtgaggagctgggattcgggctgagacgtgctagatgttcaggtggaggtgtcatggaagcatctggctgtgtgagcctggagaccagggccagggagcagctggcgggggcgtcagcccgtgactggcgttggaaggcaggaacctggccaagctcttctgggagtgcacagagggagggtggccccggtgtgtaaaggtgggcagtaagagcagaggggcctccagggcagtgggaagaaagccagtgaacacagaggcctagacacccagtgggaaaagggtcttgaggggatggagtggaggagtgcatcagatgcccatggcgggtcaaggaggacctcccaacggggctgttgtcagtgaccttgacaagagcagctttggtggaagcaagcgtctgcttggagtgggctcaagaaaggatgggaagaaatgaacaaagaaccggtggcggcacacaacactccacaggtgctttgctgtaggggagcagaggaaatggggcagtaagtgaaggggtggcccaagggagtgagtgttgctgatgggagatccccagtgctttgcctgtgtgagggggaaaggtgtggtggaggggaggaggcaggccacagatgaggatactaaagcgcagagacactcggcagcttatccagccaggcacacccacatgcacacttctacccacccacccacccacgcgtacagatgcacagatacacacacccatccagacacacacatacccagacacccagatccacccacaggcacacacagacgcgggatttgaattctggcagtcccttgcatcagctgctcttctgtactgctgttgtaatgatgctcttttggagaacgttactctttcgggtgcagtccaggtaggcctttttatgacacgttgggtcttacgggttatgcattctttacacctagagactccctgtactcagcaagaaaggatgggaccagcaactccccatcctgggcgggagtggtcggtgcgtggccaaacgtttctgcctgttcactaattcttaaggctgcatgtttcaaatggctttatcactatgcattgtgatttattatgcaatgatctcttattagcatggtgtttacagtccttttttttaaatggcagttatagatttttgtttgactagaactttggtctgtgatgaagatacaaattatcagagtctgcgattgagttgggcttctaaaaccagctgtaatcagagaaaaggtaagacatttgtgttaaagcacaataatgagtcattggtgacacagtggcacattcaggtgctttttttttttttttctctgagacggagtcttgctctgtcgcccaggctggaaggcagtggcgcgatctcggttcactgcaagctccgcttcccgggttcttgccattctcctgcctcagcctcccgagttgctgggactacaggcgcctgccaccacgcctggctaattttttgtattttttagtagagacggggtttcgccgtgttagccaggatggtcttgatctcctgactttgtgatccacccgcttcagcctcccaaagtgctgggattacaggcgtgagccaccgtgcccggccattcagatgcttttctaaaaaattcattttttgcactttttacttagatatttcctttcttggaacgagttttaagtttttagcaatggcttctcatattgtcagagtgtccatttaaatccatgcttctcctctcttctaatgtatgaggtctttgtacataatggataaaccccatcatcctgacactatgtttttttcttaaagttaagttaaaaaattattggtgaagaactatggacaccaagtggatcacttcagtaatttttgatgatttgatttctgtttaactttgatcttcctagggttagttttcctaaagtggttctgcagagagttctggatttgctgcatcagccacatgtatcactgggcagagatgagggtgtgtggggtcacttttggggtcttgggatgcttcaactacagtggaggtatattcatgacatacctgggacaggttaagatcacctgtggcaagaactgattttacaggacagcattctcagtgcagactgagaagtggcttttttttttgtttgttttttagaaaaccttttgggaagggtagataaaagaccatttcaagaatactaaaatactaaatacaccccccaaaataataaaggcaacattgattgaatatttaccatatgccagacattcttctaagtatttattaactcatttaatcttcctaacaaccctgtgaggtaacgtacatggtgtgttaattaagatttcccatttcttagtgaagcagttagctgagaggcacagaaatagtaacttgctcaaggttatagtaggaagtggtgggaatgaggtttgaacccagaaatctggctttggtctacattcttaacctttttgttatatcacctctcctgaaatgacttgcctagagaggggttaagagaatgactaagcagctgttaaaatagggtcacagaggccaggtgcggtgacttacacctgtaatcccagcactttgggagactgaggcgggtagatgcctgagcttaggagttcgagaccggcctggacaacatggcaaaactctgtctctaccaaaaacacaaaaaattagctgggtgtggtggctcatacctgtggtcccagctactcaggagagtgaagtgggaggatcacttgagcctgggaggtagaggttgaagtgagctgagatcgcacacactgtactccagcctaggtgacagaatgagagccccgtctcaaaaaaaaaaaaaaaaaaaaaagtcacagaggttctcatcactttggaaaaaacttaagtattgttataaagtgaagagaaaaaaggatattaaactgtaaacacctcactatgtttaaccacctctcccctcaaactttctaaaaaactatgcttaaaaaatgactagaaatagctgggtgtggtggcttgtgcctgtaatcccagcacttcgggaggctgaggctggtggatcatttgaggtcaggagttcaagaccagcctggccaacatggtgaaaccctgtctctactaaaaatacaaaaatttgctgagtgtggtggcacacacctgtaatcccaactacttgggaggctgagttacgagaattgcttgaacctgggaggtggaggttgcagtgagcctagatcacgccactgcactccagcctgggcaacagagcaagactgtgtctcaaaaaaaacaaaaacctcaataaaaagtgactagaaataaatatacaaagatgttaaaagtgattatctttgggtcagtcttgggattataggagttttgtctacctttttgtatattcaaaatttctataattagatatttattataaaatttcttcctctataagatattgcaaaaatagcacatagaatcctttgaatccttctcttatcttcccctggagtaggacatctttataagtacagtcaaccaggaaattgacatagtgtaacactgttagactatacaccttgtttcacaattttacctgtactgtgtgtatggttctgtgcagtttgatcccatgtgtaagtttgtgtaaccactactatgatcagagcacagaactgtcctgtcccactgctatgcaggggtggccctgtgctgcccccttgcagccatacctgcccctaacactctgtctgtcaactggtgacccgtcttcatctctgcagcttcgtaatttccgggatgttagataaatggaatcatacagtatgtaaccttttgaaattagctttttccacttaccatagtgttcttaggagccatctaagccaatacaagctgcacgtagcagtggctcattcctttttattactaagtagtactccactgaacatttacctgtttaaggacatttgaggtttttccaattcttgccgtgtaaataaaacagctgtgaatattcatgtacaggtttttgtgtggccataagttttcatttctctggtataaaaacccaagaatatagttactgggtcatgtggtaaatctatgtttagtttcttttgttttgttttgacacggagtctcactctgtcgctgggctggagtgcaacgacgtgatctcggctcactgcaaccttcaccttctgggtttaagcaattctcctgcctcagcctcccgagtagctgggactacaggcatgccccaccacgcccagctaatttttgtatttttagtagagatggggtttcaccatgttggccaggacggtctccatctcttgacctcgtgatctgcctgcctaggcttcccaaagtgctgggattacaggcatgagccactgtgcccggcctatgtttagttttataaggaactactgtaaactctttccatggtggctgtgtcattttacattccatgagcaatgtgtgagatctgttttttccgtatctttgccagcaccactgttaaaagaaaaattttggccagacacagtggctcatgcctgtaatcccagcactttgggagggtgaggtgggcagactgcttgagcccaggagtttgagatcagcttgggcaacatggcaaaaccctatctctataaaaaatacaaaaattagtcaaccatgatggcatgcgcctgtactcccagctactcagtagggtgaggtgggaggatagattgagcctgggaggtcaatgcagttgagccatgattgcgccactgcactccagcctgggtgacagagtgagatgctgtttcaaaaaaaaaaaaaaaaaaaagaaaaaaattttagacaaattaaatttaacagagttttaaagaacaatttgcaaattggtctgcccctgaactggaagaggtttagagagactctggtgctgttgcgtggtcaaggaagatttatgaacagaaaaaggaaagtgacgtgtagaaaatggaagtgaggtacagaaatggccgaattgactacacctgggcattggtcctctttgaatgtggtttgagcagttggttgcctttgattggctgaaacccggtgattggcataagagtgggttatagtctttttacatatctagttaggttatagtttactatatgcagagagacttttaggctgaacttaaaatatgtaaggaggcatctttaggctaaccttttttcttttcttttcttttttttttttctttttgagacagagtcttgatctattgccaggctggagtgcagtggcgtgatctcggctcactgcagtctccacctcccaggttcaagcagttctctgcttcagcctcccaggtagctgggactacaggcgcgcacccctatgcctgtctaatttttgtatttttagtagagacagggtttcaccatgttggccaggatggtctccatctctttacctcgtgatctgcccgcctcggcctcccaaagtgctgggattacaggtgtaggctaaacttaatttaacaactttcccttttggtcaacctgtcaagattaagaggttgaccaaaaccttaggcattgatgtcactttgtcaccattgtaaatgtgtttatttggtctcagatctccctgggaagagattgagattggctcaatctcttgagccaagagattgagacagtgagttttgtcaggtgggaacaaggactttaagttatttttttataagggttagagtagcggggacctctttatgttgggattttttatttttattagtaggagaaaaagacaacttggtctgttttagcatctatcttatgccttaataaacaaaagacaaagggtagatttagataaaaaattttaatagtacctttgttaatccataatcagtcagaaacaaaacattggttcacccctcttgacctacatcataggttaaagaaaacattgccaagaggccttcacccttctagatagatatcttttgttaggatctagatccccataggtggggaaagaatgctttttgggttgccccatttcttttaaagctgcattttaagactccctcctacccctcccttcactctctctccttggactattttattatgtgttaggataaaagagttgctacttcataggtgatagagtcacaagagagtagtagtttgtgtcatggtctctgtgggccagccttggttctgaaccttctgcttgttcctcactcggtcacgtaatgcggtgtggctgacagctgggagggtgctttgcagtggggcaaggagctgtgggaagcacagggtgctgagacagctcctcgatggcattgtagggcctgtcgccaacctcgtgactttctgttatgtactgtgcattttcaagaagggtgtacttggtttctgttgcatattgggccaaggttgttttcttcagaaatatgcattggattttataatattggtcactgaatagaagtcagcatttagtcttgttctatttattctaattttttaggatagtcattcttatttagaataatgtttaaaataataacttattaagaatacactaatgtattctaaagtttttactgacatagtctggtggaagatacttaaggctttgcttaattaatatttaatgactgtttaaaaagataccttcatgctgatgttaaagtaattaatgccaaacactgtttgcacatctctcctttgaaggccgtgctggacgagtgtctagagggtactgttaccggctggtacacaaggatttctgggacaactccatccctgatcatgttgttcctgagatgttggtaattcactttggtcattgtcaaagtttatttatttatttatttatttatttatttatttatgagacggagtcttgcactgttgtctggactggagtgcactggcatgatcttggctcactgcaatctgcctcccgggtttacgcgattctgctgcctcagcctcccaagtagctgggattacaggcacacaccaccacgcccagctaattttttgtatttttagtagagacagggtttcactgtgttggccagactgatctcgaactcctgacctcgtgatccgcccgccttggcctcccaaagtgtcaaagttaattttttgtagatagttttgccaaatagtctaagtgatataatttctagtgtcatctaattttgattccagaaaaatccttgtcttgccacattccccctcactcacaatctgggctcactattgattacacatcaggctactgtctagggcgttacccacattttacagttttaatgagaggatgttttctggtatctatgggctctataataggattgtctttaaatgctgctgttttctatgtccctttataatgagtaattgtgggatcagctttttttccttcctcttttctgtgtctctccccttcctttgtcctccttcttttttttcttctttccctctccctgctttcttgctctcccacttttcagtccctcttttccttctcttttttcttccttctctctccccatctttttatttttccatctctttctctcctgttctttcttcttctctctcccttctcttctctccctccctcaatcctctccatttttctttcttctctcctctccttctctcctcctctttccctctgaagcactggttatgtgaatcggctaactgatttagttatgttattatttctaatctcaggcttgtttcttttcagcgttgtccattaggaagcacgatcttgaaagtgaaattacttgacatgggtgagccgagagctctgctggccactgccctttccccgcctggtctgagtgacattgagcgcaccatccttctactaaaggaggtaggactgcctgctggttagtactgttggcatctgtagagctgtgttctactgtggctccctcagtctgtgcctcactttcccactaactctgatcctcccgcctcactttcccgctaactctgttcctcctgcctcactttcccgctaactctgttcctcctgcctcactttcccgctaactctgttcctcagcctccttctggcttgcttcatccattcctggaaaccctgctcttcctacttgggattctttgactgcacacctgactcatactctgctctttgaacttgtaaccgaggccttggtacaagctgtatcctagtgtacatactgtgctggggctgtggacgttctgcttctgaccttcgaagttgaggatgcttctggtgttttaccttctttattatgattgattgattgattaactgggtcttgctctgttgcctaggctggagcgcagtgatgcaatcatggcttactgcagcctcaaacactgggctcaagtgaccctcccactgtggcctcccaagtagctgagactgaggtgtgagccaccacacttggctgcctttaaatatgatacctccttgggtttctatgaaatacactgtgtcaagttaaggaagtttttccccatacatagttcagtaaggttttgttgacagtgacagctgggagatccttcacttagtactgtgcatgccatatttgttcaagagtgaggtgagtagaattctgtgaaagtcctttagtgttacctcccaggatcatacttttaaaaaaaaagtaaaatgtgttctaagtttcaagggaaaatttaaaaagttttttttggtaacatatcaacctttcataaattgacttagaatgttattcaccaaaattaggtctttgtttcctgttttggactctccaccttaaggggaagaagtatgagtaagtcagtgcttgataataacactaattttattttataaaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattataggtaagtgtgagaacaaataaatgctaatgggaagtttatataacaccactctcacaatcttacattcttcttgtttattttttatggttagcggcagctctttctttgaagaatttttttgcaatgcctttccggcagcatctcgatggatataggtactgaacattcatattttaaagtgtcactgtattttaatggtattgaatgacactgttatctgtttataggaacaaagtgaatttctctggcagtagcaagagtgactgtattgcacttgttgaggcatttaaagtaagttttctgttgtgtaaaccatgaaagcagctaccacagattgttagtacattttcataccacaaacatatgaggtagagacagacaatgttttatctagtgaaagtattatcagggttattggtgtccagtgttaaattaaccgtgctggaagaagtgagtgaggtggaagtccaattttatgaaattgattgaaaaaattaaatttgtaaatttttatgttgtaaattttcaggtttgttgaaattgtacttaaaaaaaattcagtgagccaacacattattttgaaagtttggatcctttattttcagacatggaaggcttgcagacagacaggggagctgcggtacccgaaggttggtgagccctttcctgctgctttctagatggctgggagtaatgagagaaggactctgtcttggtacagtcatagcgtgtgaatcatgacggtgccacctgcggctggagtcgaggtcactgtcagtgctcgcacggctgtcccaagagtggcaggccataatctccgcagactggtccttttgcttccatcgcttctcgggaggccgcttgctctcaggcctgtgctggagctgtgctgcttgtttcatggctccacattgtactgatcttgccatggtgtctgcagcctctttggctgtatttcatagctgtgggtactgggttggacgtgtcagttcaaaattgagggccatgtggctgctgtttctgttttcagctcttttagataacgggcttaaaagaaatgtaatctgttaccctccattttattgttttttttttttggtcaggctttgctgttcttctaaacttatttggttcaacagactgtttacaggtctgccgtttctgtgtggagatttgctgtgcttagatatatctctaccaatacatatatgagttaggtgtttaaagtcttttttttttttgagacggagtctcggtctgtcgcccaggctggagtgcagtggcacgatcttggctcactgcaagctctgtctcctgggctaacaccattctcctgcttcagcctcccgagcagctgggaccacaggtgcccgccaccacacccagctactttttttgtattttttagtagagatggggtttcactgtgttagctagggtggtctcgatctcctgaccttgtgatctgcccgcctcggcctcccaaagtggtgggattacaggcgtgaaccaccgcgcctggcttaaagtcttttaaaggctcagctgtagtatttttcttgttggtatataatttgtcagacatcttttttcaagataatcaagttatgtctacctttaatttttgagacaggtgaactcagaagagtttctgtattgtgtttatggttgagtattacgctctctggcttcaatgtaaaattggatgtacctggagagggagtgccactgtcaacttgagtagctcagtaatttacattcatcattaaatttttggatgaaatatgtattaaagtagctaaattcagctctaatttattaccttaatattgagtattctgcttttatatatttaaaggatgaacttaattggggacggttaaattacattcaaatcaagagaattagagaggtaagttaagttttttgaccaaatggatgcaaataaagttgacttatgaaatatttattaaatgacaacaatatttattaagtacgtgggtagtaatgagtattccaagaagtgtatttcctgcctgtttccagctttagtaggagtgtctcttgtgttttcacctttcagtagaactacttgggtttctaataaatactccttttccagttaaggaatgtatttcccctatgtatactttaatgaggaatggttgtgtcatcttgttgtatgtcttttcagtatatgtcaggataaagagattgggtgtcgtggctcacacctgtagtcccagcttctgggaaagctgaggtgagaggtttgcatgagcctgggaggcagaggcttcagtgagccgtgatcgcaccaatatattctagcctgggtgacagagcgagagcctgtcttgaaaaagaaaaagataaacatatggtattttaattttttacccactaatacaatcttacattgcttaatgacaggaatacattctgagaaatgagtaattacatggttttatccttgtgcaaacagcatagaacatacttacacagacctagatggtatggcccactacacgcctaggctgtatagtgtagcctatggcttctaggctgcaaacctgtacagcatgtgactgtattgaacactgtaggcaattacaacaaaatggtaagtatttctgtacctaaacataactaaacatagaaaaggtgcggtaaaaatatggttataaaacagggtttcccaacacctgggccatattctccttttgagaatataactaataccagatctcaggtggagcagtttcatcctgaaaccatccccatctactccggcctgtgggaaaattgtctttcatgaaactggtccctggtgctaaaaaggttagggatcactggtataaaagataaaaatggcataccaatatagggagcttatggtgaatgcagattgcaggactggaagtggttctgggtgagtcagtgagtgagtggtgagggaatgtgaaggcccaggacaccactgcacatgactgtagactataaacagtgcagacttgggctacactaagttcataaaaatttttaaaaaattaattgtagcttaatataactttttttaacttgataaactttttaattaaaaaaaatttttggctcatattaacacttagcttaaaacacaaacattgtacagctatgcaaaaatattttctttctttatatccttattctataagtttttatctatttccttatttatttggtttttgagctaggatctcactctgttgcccaggctggagtgcaatggcatgatcacagctcatagaagccttgacttcctgggctcaagcaattctcctgcctcagcctctgcagtagctggaactacaggcatatgtcaccactcgtaatttgttttttctttctttcttttttttttttttttgagatggagtcttgccctgtcacccagggtggagtgcaatggcacagtctcggctcactgtaacctctgcctcccgggttcaaacaattctcctgcctcagcctcccgagtagctgggattacaggtgtgcgtcaccacgcttggctacttttttgtatttttagtagagacagggtttcaccatgttggccaggctggtcttgaactcctgaccttgtgatctgcctgccttggcctctcaaagtgttgggattacaggtgtgagccactgtgcctgtcctaattttttttattcttttatttttttgtagagacagggtgtcactttgtagcccagactggttttatctattttaaaaaataatttttatttgttaaacttttttgttaaaaactaagacacacatacacattagcctaggcgtacacagagtcaggatcatcagtatcactgtcttccgcctccacatcttgtccactggaaggtcatcaggggcagtaacacatggagctatcatctcttacagtataatagtgccttctcctggatacctcctgaaggatacctgcctgagactgttttataattaactttgtttgtttcctttttttttttttttgctacttctttcaagacatgtgaagttaatttaaaaaaaaaataggagtatatactctgaaataatgatggtatagtatgataaatccataagccagtaacatagttactatcattatcaagtacagtcatcccttggtattcactggagggttggtttcaggacccctgtataccaaaattcacgaatactcaagtcttacagttggccctgtggcgcccatgtgaatagtcggccttccatatactcgggcttgcatccctcgaatactgtatttttgatccacatttggttgagaaaaacctgcatataagtgggccctcgctgttcaaccccatgttgttcaggggtgaactgaaatgtactgtatgtgttgtatgtgctagactttcatatgattggcagcacagtaggtttgtttacaccagcatcactgcagacacgtgagtaaacgtgttgccctacaacagctatgacgtgaccaggcaacaggaattttctagctctgtgacggtcttatgggtccacagttctatacgtgtccatggtcaactgagacactgctatgtggtgcatgacttatacatgaatacatgatggatttcccactgttgacccagccacgtgttcttagaataaactctgcttgtttgtaatgttttctcccaaaacattgctcggttctgattgccaatattttctctagaatttttgcctctatatttataagtgaaattggcctctggtttacgtgtgtgtgtgtgcatgtgtgcgcacatgcatgcacaatactatgagatgttgttattgataccaccctggtaggatgaacatctttctgtacccaggaaccattttaatcaacagtttaataactagaaatgtatttcttacatatttgatagaacacattcaaaaacacctttgggattagtgcctttttgagggatcaattttaaaaaaaatttcaatacccctggtagttactgatccattctggattctaattcttctggagtcatttttgatgagttacgttttttcattcaggtacccatttaatccagatcatgaagtttattgatgtatagttacacgtaattttcttaatttcaaattcatgtcaactggtaacacctttcttgttcttattgttgtgtatttgtgtactctcattgtttcttgattatatttgtatattcagggagtccccaagaccatcctcaggttcactgattggctagaaggactcacagaagtagaaaagctgttatgcttatgcttatgatttattttagccaaaggatatggattaaaatcagcaaaggttaaaaaaaaaaagtgcatgggaggagccctggagagaccaggtgcaggctaccaggtgtcctttcccagtagagtcttatggacagtgattaattctctcagcaacagtgtgcgatgacaggcatgaagtattgcaaccaggaagctcacctgagccttggtgtcctgggtttttattgagcactggttatgtaggcctagagtacccatgtgactgactttagttactcagtcttcagtccctccagaggaaactgttaccctcatggcccaaggccccaccgtcaatcatattctagcgtgaactcttttgtgtggcccaaggccccaggtcagcatgcatactcttatccaggagggtaagagtccctggaggcttggcaatgacctttcaggagctgggccagggccaagcctttctctggaatgtgcatggtctggacagccaggcctgctggattactcctttactgcagagtctgcaagatgcttcctttgtgttattgtattttcagagagcttactcttagtttcatttgtcagttttcttgtgtatgttttttgggagggaaggagtaggtgtgggattctaaatcattgctttttttttttttccattaatttagttctcctttgacttttagtttacttcagtctttctgaaattagtatttattattaataataatattttcagtctttctaattaaaagcatttaaagctatgaattttattatgagcagctttagccaccacatcctattgatttttgacattcctgtctataatttcttttagtgttggtttcctctctgactaaagagtttatttttattttttagagacagggtctttgtctcccagactggaatgcagtggcataaccatagctcactgcagcctcaaactcctgtgcttaagcaatcctcctgcctcagcctcctaaagctctgagaggtgtgaaccaccgtgcccagccctgaaatgtttttaaatatctttttgttgttgttcatttctgattttattgcattttagtatagagagtggcatagtcttggtttttacttagttcacttacatgtgattacagtcacatgaaacagttccatccctcaggggtacagaggcgagcatctgagtgtgctctcccttgcttcccatgtcccaggcttttcctccctccacagagatagtggctgctgagtttttctgtcctttcaattctttttagttgttattccccccagttatgttcacacttgtgactgtattctttttgtaattgagatacttttgtggtgacttaatttatgatcagttcataggtatttggagttgtgtattttcatgtgtgtacattaaagtttgacattttgtgtgaaacagtttttattacaactggatattgattttattttcctgttcggagggactatttggccataggtcacttactttgtttttaatcacaaaagccgtacatgttcatggcagaggctgggacgtgtttcaaggatctaaagcaaggctgtggtcatggctctctgctattctgacctctgggtgggcacagttatgcgtttgcattggttcccatctcaggggtgtgtgtttataaacagatcagggagcatatatgattttgtattctggtattttctctaagtgttatattgttcatccttaacattacttattaattaatttctaagaagatgattcttgccaggcatggtggcacacgcctgtattgccggttgtttgggaggctgaggctggaggatcacttgagcgtaggagttctgggctgtagtgcgccatgctgattgggtgttgcattaaacgcaacactgatgtggtaacctcttgggagccagggaccactgtgttgcctaaggaggggtgaaccagccaagttggagcaggtcaaaactcctgtgttgatccgtgtgggattgtgcctgtgaatagccactgcactgtctagcctgggcaatatagcaagatcttgcctctaaaaataaattttaggccaggcatggtggctcacgcctgtcatcccagcaccttggggggccgaggcaggcggatcatgaggtcaggagattgagaccatcctggctaacacggtgaaaccctgtctctactaaaaatacaaaaaattagctgggcgtggtggtgggtacctgtaggcccagctactcgggaagctgaagcaggagaatggcgtgaacctcggaggcagagcttgcagtgaaccaagctgtgatcgcgccactgcactccagcctggacaacagagcgagactgtctcaaaaaaaaaaaaaaaaaaagataataataataaaaatttttaagagattatttctttttttttttggagacagaatcttactctgccacccaggctgtagtacagtgacacaatcttggctcactgcaaccgctgccctccagtctcaggtgatcctcccatctcagcctcccaagtagctgggactacaggtctgcgccaccacgcccagctaactttgtattttttttgtagagactgggtttcgccatgttgcccgggctggtttcaaactcctgagttcaagtgatctcccaaccttggcctcccaaagtgctgggattagaggtgtgagtcaccgtgcacagccaaaagatgattcttaattagctgcagtgtttcattctgtagctgtgtttatactttacccgttgtgcacttattttctagtgttttcactgctctgatgacatatgtacctttgagacatcagatttcaatgtatttttcttaggtggctgaattatatgaagaattgaagactagaatctcacagttcaacatgcatgttgattctcggcgacctgtcatggaccaagagtatatatataagcagcgattcatcctacaggtgtgctgaagtttcctggatattttttttcctgattctttctgcttacaaggtcttgtggtcgagaaactgcttattcctgctttctgatacaaaccaaacctcaaaggagattttaggtccatagtgttcatactgcgtttgggaaccaggaaacattcttctttcatagtttgcattatttgttgagttgatgattcacctagagagtatttattgtttatttattaatatttaatggattcagacccatttctaatttccaggggagtgtttctatagagtacctgtgttatcactgcttcaggagagatccttttgttttagcttttaagaaagtgaagtgctctttatatcgttcagtgtatatagctattcccctacactgaaaatattattttaactttggaggccatggattcaaattactagtagttagctggaatgtagcgagtgagaagtgtgtcctggccagtggagactgcctctgctgtagggtttcctagaagggttggctgatgcatacggaatcaggtttgaggtagatgcctataaaccgggtgtgctggaaatgtgcgagtgttttcctggatgtaaaattgctctaaggctgggggagtctttggtgggtgtgtttcaaactggtatgtttttattgaagaagggactctttgcagagtgcattttagaggtgaatagtggatgccagcctgctgccctaaatctgagtgctccaattggagttttatctgaacatctgagagtaccttgcacatagatgtgtgtggggagaagtggagaaagttggccgaccttggggctttgtgtgtaggatggtttatgtccttgttcaacttgccactgtttcccaagcctcattctgagaagtactcaagctcttttgaagaaagatgtttctgttaggtgaaaaaagtgtttattttttagtgtttctgttagatgaaattaccagaattgtgactttctgcttggttggtgaaaggtctagttttccatacaaacgataaccatcttttacatttatggatgtcatatcatgctgggttgagattagtatattggtgagaataactgataaaataatgctgttacttcatgaaaataaatttctttttcaggttgtattggcaggtgctttctatccaaattactttacttttggacagccggatgaggagatggcggtgagggagctggctggcaaggaccccaagacaactgtcgtggtaggtgctgggggcaggccgtcctctctggggtgtggtggggcagaacatttttgttctctaattgtttctattcttgtgagtcctaagtgaattttcccctggcgtgaatattaggcttgtttggccttttcaggtgtatctaggcttgtttggccttttcatgtgtatctacttgtccctcagtctcttgcctccttttacagacctggccttataaggaagccttgagagtttatacgttcaaggtcaatgctgatttgatcatgtgctattttgaaggatttaaggcacttacaagtttaagaacattttcttaattcacaacttcatttcatacaaaataaaatgttattggttggcagctgagtgctgtggcttaagccagtgaccccccgacctggatgcccaacagaactacctggagagtgcttattttatttatattcgttgaaattcagatctgaaggctctgcgagatctgagctagaaagtatgccctagaaatcagcattcaagtagtgtgtactttgggcatatctaatgatcagccacaggccctgaccattgaatcagcgtttgcaacccagttgtttaaagcccagcagcagggagactcacactggaagaaagctgagactggactgttttggatcacttggttccagtatgtgcctgtatctgataaggcggggtgagaagcgcttgaagttccttcgtgtcatatcgtaagggctcagtcattgccagattttatcctggttattgttacaccaccactgttagtcctgaagaaataaatagctcataaggaaagggcgcagatgacttgagattacaactggaggtctttgatgagcaccaaaaggagctggtgctctggagatgagagaggcagctgagatacacttgatacccgtggaagggactttaaaaggaagtcattagttttttatagctactgaggatcatttgattggcacctctgctcctgctggccatcaggtttgactaagctctttgcttggcttcctctctcacccctctgccccttcgtggttttcttccctcagctgtgcgcaagaggaagggttctataggtctcttcctcagacgtctagtagctatgcctgcatccctcgaccacagagagcctagtctgggggcccaaaattacctagtgtgtacatcataaaagctcaataatagctggctttacttagcacttgagaggctgtgtgttaggtacttttcattcttctctgagcctcactccaccctttgagttggggatttctcatgtcattcttatttcatgatgtggcagttgggtctcagggtaactctgtaacttgcctaaggagacacgcggattcagggagtgaggagacaggatctaactggatctgagccccagcccatgccttcacttacatgccttctgtcacggagccccgtgcagagctgcgctggcacaggagttgtcctggtccagaagaaagtatggagtgctttgcagaaacccagcatggtaccttgagagtttatacattaaaagtcactgccaatttgatcatgtgctatttggtctttccactgtggtgatgaggaaatacatattcctctcattagttagacattttcctttaaagtttacattcccattattccttatgtagaaatatgttttgaaaagaagtatttagtaagcttgattattttaagggaaaacagaagtaaacaaatcttaattttgctgtattagacttacaccattttaacagggttagaattagcctttatttaacatatttattatagaacttagttagaatttaaaagtctttaaatgcactgatctgtagagtttatatattatggttaaagatagtaaactatgtttttagaaactaaaacagtgtgcagcagctttgagcttgtgaatgttgaaactattttgttagctctagtaatctgctctgattttgtgttatattttacagttgaaacacattcctccctatggatttctttactataaacaactacagtctctctttagacagtgtggtcaagtcaaatccattgtatttgatggtgcaaagtaagtatatttttgtaatcaactgcaattatgaaggaggcataatgattcaaatgtttccagacgctgattgttaaaacggagtgcccatggaaatgggtcctcctatgggctgctgcaattggctttcagaatgtagctttggtttatcttatggtcagaagcaatttgtcttctctttctgctaagtgacctcctaaaggaactaagctgctggttagtggtcaagcatggtcactccaagaaggctcagtaactcagtgtgatgctaaggcggattctcttaaagtgatcttcactttcacgcactggtctgagattttctcagtgagtcattagtaagagttattttgtgggccatgaaggtgatccaaaatagagtgtatctgcttatagttgtctaaagcagatatgttttgaatatttttggaaggcaaacattgtaaaaactcaatttggctctacttactgcatgtaaggaacaaatgtgtgttttggagcatcactgagtttttatttctaacaggaaatgtttatgtaccaaaaagcctaaagtaggatttttaatttttaaagttagaaattttttccagtgttctgtgaatgttgtataaatttttatttaactttacaaagctttgtaaataagaacaaacactttttctttaatgtccagttcactcaagttgaacattaagtccattttcaatttggggtaattccctccggcattttaagttccatttctatgattaatatattgattttctttgtaggcctgtaaatgcttcatgaggcaaacacacaactccctaataagcaaaaccttcctaagtgctttgaacaactcttagagaattaattaaacttgtagtgtctgaacttttcttaaatattctgatgtaaattatagtaagattcttagtcacatatataaagtaacttacttaaagctggaatcacacagctaaactcattcctgaatagtgtgcgtctgcttacctgggtgagcttccagttctgcatggatgctcctttgactgatttgagtggtcagaaggcttggctcccagaagattgcagcatctttgttccctcttctttacaactggattgggttctgtgtttgttgcctgttcttcttgcctgggacttttttttgttttattatttttatttatttatttttgagacagagtcttgctctgtcatcaggctggagtgcagtggcacaatctcggctcactgcaacctccgcctcccattgcctgggaccttttttataggtgtttatatcttttgcattcctcatatttccagctctcaagtcataatacaaatgtcataccaattttttgggggaagtaacagtattctttctgtaccagtaccagttcttgggattcaagtatttaaaggcaaaggaagttacagtgattgaaagaataagaagtgtatttcttttggcatagagcaggggtgacttcatgtagactctgtgaggtgccaagggcgcatgggcagatgggcacaggtggtacctgggcatatcatgttctcccataagaagctttcaacttcgtggtaggagtggagagtcaaattagtttcacagacatttgcctgctgtgagatgtcatgggaaaggcctagaaggtcagaagaagacattctatctgaggcccaatattagagcagtaacattaatttgagacttcctcgggtagacgtcggagggttgtgaggcctcgggctggtgcagtggccagtgcagaggtggtgcagtagggtcaggtggttttccagcaggaggcagtcattagctgatcttgacaggggaaagctgagactgtgcacacatagctggtagccgtttgggcagagctgctccgtgtcagatggagtctgttttgtggaggtcaggtgctgactttgagacagtcttctggcagactgatgagtgtgaacatgactaggtgggcacttggagacctttgagtggtctgtccggaactgtgttttatggaacttactcagggataagcggaaggtcaaggtaagaggagtagaagccggcctggagtctttgcagtagtccaaagcagaggtactgagatgtgcagccagtatggtgctgttggacatgaaaaggagccaacagacgggaaggaggatgtcttggatttgcctggtgattgcatgtggggggcaaagaagtgagaggagcccaagagcatccggctttccagcctggatgctggggaggatgcagcttcgaggagaagacgctgaggtctggagtttaaaattacttctacggagtcttaggagagactctaaagaagggagataaagcagaagggcatgaatcaggcagtgggtggaaggaaaatgcgtgcatttatgagtgaagaggatggggcgtgaaggagagcggaggaggcggagcgggtcagggttgattcatgtacctgctccacacacctcccctgctgggcgtctttccaaactgctcaaggtgtacatttccaggagagagctcattacaggacgatttttatagtagaggaaggggcccaggtctgtttttgtggctctgtgatgatgtggggacccaggggcattagaacttgcatgcatagcaaggtaaacttgatgctgtcttccttctgcctggcacatccagcaggcaccttttgctccatgcctgctcctcatgccccagagtggggctggaatgggacaccgaaatatgggctggggcaagagagggcatttatcaatattacttggtgttttattctgttctctcggtgctataaagaaatacctgaaactgggtaatttataaagaaaagaggtttaattggctcatggttctgcaggctgtataggctgctgcttctggggaggcctcaggaaacttacaatcatggtgaaaggcaaagggaagctggcatttcttacatggctggagcgaaaggaagagagcaaaggggaggtgcttgtaaacaaccagatctcgtgagaactcacaagaacagcaagggggaaatcgcgctcacaatccggtcacctcccaccaggcccctcctccaatattggagattacaattcgacatgagatttgggcagggacacagatctaaaccatatcacttggcaatcaatttatatcacttggcaatcaatttatatcacttggcaatcaatggttttggcccaggcgctgtggctcagtcctgtaatctcagcactttgggaggctgagatgggcagatcatgaggtaaggagattgagaccatccgggccaacatggtgaaaccctgtctctactaaaaatacaaaaattagctggacgtggtggcacacgcctgcagtcccagctactcgggaggctgaagcaggagaatctcttgaatctgggaggcggaggttgcagtgagccaagatgacatccctgcactggcgacagagcgagactccatctcaaaaaaataaataaataaataaaaataaatttaatgctttttttgaaggggaattacaaagatcactgagctatatacatttgtgtggttttctgtatctgttttattttatgatagtaaagaaagacattctgttataatcatgaaaattcttttgcaattatgaaagtaattatgaagtaagatttctttgccccaaattccatgtgactttagtgtttattctgcattatattatacaaggatgatacttggttttggtttaatgacatgtcattataacttttatttctcttcaattaataattttccattggagaaattaatacatgttattgattaattataaattgaagagttactggcattttgaggagagatgtgacagaatttctgtcttgagagaaatgaatatgcagtttttaaacagatgcctgataaatttatttttaaatttacatttgtggaacagagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaaggtattttcgggagggaggtggcagacaggccgtgcctgctttcacattctcaggtgctatttttacatgaccgttgatctggcattgcttcagatcatggtaaaagcactggcttggctgggtgtgggggctcacgccactcatccagcactttgcgaggccgaggcaggcagatcacttgagcccaggagtttgagaccagcctcgccaacatgatgaaaccctgtctgtactgacaatacaaaaattagccgggcatggtcgcacacacctttaatcccacctactcgggaggctgaggcaggagaattgcttgaacccaggaggcggaggttacagtcagccgagattgcaccactgcactccagcctgggcgacagaacaagacgctgtcttaaaaaataaataaataaataaataaataaataaataaaaaagcactggctttgtggttgagtggagctgctgttgaatcctggttgcatcatctcctcactgtgtgcacttgggcacattacctaacctctctgaacctcagttttttttctgtttaatagaaatgataccagccgggtgaggtggctcatgcctgtaatccttgcattttgggagaccgaggcgggaggatcacttgaggtcaggagttcaaaacgagcctggccgacatggtgaaaccccgtctctaccaaaaatacaaaaaaattagccgggtgtggtggcgggcacctataatcccagctatgtggaaggctgatgcaggacaatcaattaaacccaggaggcagaggttgcagtgatgagctgagatcacgccactgcactccaccctgggcgacagagcgagactccgtctcaaaaaaaaaaaaaaaaaaaaaaaaaaaaaaggatacctatggtgtaaggctgttgagaggattgagtgatatcattgatgtaatttttagttaaatagtagggattaaatctaatgttaatttcctgtcttcctagataggattatgcattttgttttgcaaattctctttttaagtaatgtggaatattttttgtcttcaacacagcagtcagtgggacataatggagatgcagctgggagcacctagttgcttaccagtgtaagctgcccttccttgccaaatggcatctttccctcccgcccagagagtggtacagggccagggctgtctgtagggctggtcagcccagggcaggagcacttgctgcatgcagctgtcataaccctggtggatcttcttctcttggaccaaactgagtcacccatggtatttgtgacagactgcttgccttttggccatatccccatagtcacctatgtgggaagtctcatttattatttcttaattgtagagttttcagttctgggaggaacttaacaggaatctgaggagttggtggaggaaggcaaatctgttccatctggtttcacccagtgtgtgacttttggtttctgagagtttgggagtgtagtgggttcagtccttcatgtagagaaggcctgtcctgctctagtgaggtcagactccacttacttttgtaatcgaatgctggggagtcactcattgcctgagtcactcattaaaaataggtctggagattgggaaaagagttggatcaagatctttcttataattctttctcttcattttagaataaagtattaggaaatttttattttctgtcaaatttgtcttttgtattccagaagtttagcatttactatcttattgcctttaagggaaaatgatatttttggggtttattggaaagtcatgtgtgtgttttctaacatagcattgagccaagcgtggattcttatagttttctaaaggtcaaggtgcacatttgaaaacacaagttaggaaacactgcagataattctaaatctcagaccttgaaagtctaaattgataatttatttatcttgataataccttgaaagtagatattctctgagagtcttggccttcacaattatatactacttggagggtagtatataatttttgggatgtgtaccccttccagagctcttcaaaaagccagcagaaattcatgtttgagatgaaatcaaatttgtcatctctggcttaggtattttattgaaatgttcttttcttgtagaaatattagaatagttcaagtgataatttcacatatgtaaatgtgttttctttgtaaaacttgatttttattttaataaaaattcgtattatgtagggtgaatgtggacttccagaagcagacggtagatcctatgcaagtctcctttaacacatcagacaggtcccagacagttacagatctccttctaactattgatgtcacagaggtaaggatgaagtaattgagcttttccttcttcttaatctaaaatcatcatgttgtatacaggaagtttacacacacacacacacacacacacacacacacacacacacagaacttgtgcaccttggtaatcttgttaatgtgggtgagtttgaattatcactctacttgttaaattgaaatatgactaaaatggaaattgaaacatacttattctagaatcaaagttaatttttaaaatatcaagtacatttaaaatgctgaaataaatcagatttaacaagatacatgttagaggaaaaaaaagtgtgtatatttttgaaacaaagtcttgctgtgttgcccaggctggagtgcagtggcacgatctctgttcactgcaacctctgccttctgggttcaagcgattcccctgcctcagcctcctgagtagctgggattacaggtgtgtgccaccatgcccgggtaatttttgtgcttttggtagagacggggttttaccacattggccaggctggtctcgaactcctaatctctagtgatctgcccacctctgcctcccaaagtgctggcattacaggcgtgagccactgtgccccgccgaaatgcttatatgacctcagaacctttatttatgtaagaatgagtcttgtaccgccaagaaaaggatatattccacacatttccttaccttagttcaccaggggaccccctctttttgtctcataaacacctgttaaaaacctgtaaatacttatgttccgaggattaacgctggtgaggtgtcgtacagcacagggtgtcagccctatgattcaagctcattttcctccttacaaaagtcctttctagatttcatctcttctcctcctcttcctttttaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtaggtttttctgtaacaagtcactggaagggaaatgagacagacagacgtacagcagtttatcaaatatcttttataattgtaggtggaaattaaaataattgcagttagcaaagtagtctgtttccctcattgatatgtggatttaagctcaggtcactccaagaattctataattataggattagagcagactgctgcattgctattgctcaggtagggcattgtttttgaccccgtcgtaaagtgtatacttgctttattttctaggtattctttgtagattatggcaataagtctcatgtagatctacatcttttgatggagattccctgtcaatttcttgaacttcctttccaggtaaggtagagaagactctagggaatgaatgctgcatgctggacaggattcctgggtggattcctgggtcatatggtgccctgcctcggcttacagctaggggagccaaggcccaggacagggagggacttgctttgtcacaatagccaaatttggtttctgctcttccaaaaatacatgaaaggattcagatttagcaaaaaaagttgttttaatccagtagtatcttctaatactgtttctgagttttctggttatgttgaaaccagacagactttttaggtaggccacagacatagtcacacatgcccttaccatcagtatgaagacaatctaaaaattattctaaatatttcttattgttgttaaaaagcaaaccaagtttctttaggaaattctcactaccccaacattagttttattgggacttttatgagaatattattgaaggtacatgaacaaggtctgttttcagtggtatttgggatgagtgttttgcttatttataaagctgtttgagctgtgcccttctgtccttgtaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaaggtgtgtgctttcgccgttgctggagcacgcgtttgtgtgagagagaacggggcaggctttccttcctctgtggaccctgagataggaggaggcggacagtgttcctcttcaccatttggtttgctgtacttgtgttaagactggtggcaccaatttaaatgtcttctagctttctctgagactaaagtatggtggctgggtattgtttttgttggtgagtattgtatttgtttgtctcctatttagcttatttttaaaaattatttatttatttatttaacatattttttagtagagatagggtctccctgtgttgcccaggttggtctcaaactcctgggcttaagggatcctcctgcctcagcctcccagagtacttccaggtgtgagccactgcacccagcctcctattcagctttttatcttcttaggatagatttgaaaatgttctatatatgtggggagttttaaaaatggattccaagatttatctccctaatggaagtagttaataaaatatttcaaatatttcaagcatttcaaaacttctttcaactgtttctttgaaaatcagtgttagagttatttttcacgatttaaaggtttgagaggccacttctttttccttttttagttgccacataatcattgtacatatttatgggatatagagtcatattttgatatgtgtatataatgtataatgatcaagtgagggtaattagcaaatctgtcacctcagacatttattatttctttgtgttgtaaacattcaagaactttcttctagctttttgaaaatataccttatagttaaccatatttaccccacagtgctgcagaacgcaagaacctattcctccaatctagctgtaattttgtttgttaaccaacttctctctattctccccttcctgtcttacccagcgtctaatacccacaatcctcctctctacttccattatttcaatttttttttagctcttactcataaatgagaacatgtcatatttatatttctgtgcctgacttattttacttaacataccatcctccaggctcatccacgttgccaagaatgacaggattttttctttttgtagctgaatggtattttattctgtatatactgcattttcagtatccattcatctgttgacggacacctaggttggttctgtatcttgactattgtgaccactgctgcagtaatcacggggtacaggtatctctgatgtactgatttcctttcctttggataaatatccagtagtgggattgccagattgtatgttcgtactgtttttagttttttgagtaaccttcacactgttttcaataaagactgtattaatttaccttcccaccaacagtgtataagagttcccttttctcagcatccttaccagcatttattttttgtctttttgataatagccattctaactggggtgagatgctatctctcacgatggttttgatttgaatttccctgataattagtgatgttgatcatttttcatatatttgttggttatttgtatgtcttcttttgagaaatgtctgttcagatgctttgcccactttttaattggattatttgcttttttgctgtttgagttccttgtgtattctggatgttattcctttgtcagatgagtagtttgcaaatattttctcccattctacaggttgtctcttcattttgttgattgtttcctgtactatgcagaaggtttttagtgtaatatagttccatttgtctatttttgttgcctctgctttttgaagtcttggccataaaatccttgcctagatcagtgtactaaagtatttctccttgttttcttctagtagttttttatagttttaggtcttacatttaagtctttaacccattttgagttgatttttgtatatgtcaagagataggggtttagtgttattcttctgcatttagatgtccagttttcccagcaccatctattgaagagactctcctttccccaatgaatgttcttggagcctttgttgaaaatcagttgcctgtaaatgcgtggctttatttctgggttctctattctgttccattggtcatctgtgtgtctgtttttatgccagtataatgctggtttggttaccgtagctttgtagtgtatttctaagtcaggtactgcgatgtctcttgctttgttctttttgcttaggattgctttggcttttggggtattttttggttccatatgaactttaggattgttttttctatttctgtgaagaatgtcattggtattttgattggagttgcattgaatctgtagctcgctttggatagtatggtcattttaacaatataaattcttccaattcataaacatgagatgtcttaatcatttgtgtcctcttcaattgctttaattgatattttgtagttttcattatagagatcattcacctccttggttaaatatattcctcggtattttatttttgtaggtattgtaaatgggattgctttcttgatatcttttttagctagttattggtgtatagaaatgctactgatttttgtatactgatttctgtatcctgcaacttttctgaattcatttatcagctctaaaagctttttggtggagtctttaggtttttctatatataagatcatgttatctgcaaagagggacattttgactttctcttttctaatttggatgccctttctttcttcctcttgcctaatttctctggctaggacttccagtactgtgttgaatataaatggtaaaattgggcatccttgtgttgttcttgttcttagaggaaaagatggcagttttcccctcttcagtatggtgtttgctgtgggtttgtcatgtatggcctttcttgcgttgagatatgttccttctatacccaatttgctgagaatttttttatcttaaagtaatgctgaattttatcaagtgctttttctgcatctgttgagatgatcagagaggccacttttgaagctcatgttgaaggtcttttacttctgttatttctgctggggatgaagaatactgggtatcaggaagggacagtctagcaaaatgttagccagagtgctggctaaattctgtatttaatttatataaaaacacttcagggaattatgttaatatttccagtgtaaaaccaaaattttacatacaaaaaagtcctgtaaaaatgtttctttcttgcaaacgatagtaagagaagaaaaaagaaaattaaaaaaactgtagaccaggtgcagtggctcacatctgtaatcccagcattttgggaggcccaggtgggcagatcacctgaggtcaggagttcgagaccagcctgaccaacacggtgaaatcccatctctactaaaaatacaaaattagctgggcatggtggtgggcacctgtaatcatactactcaggaggctgaggcaggagaattgcttgaacctgggaggtggaggttgtagtgagctgagattgcgccattgcactccagcctgggcgacaagagtgagactccgtctcaaagcaaacgaacaaacaaaaaccccaaaaaactgtaaaaaatgtttatttctcttaaattctctaatgggtaaaatgttgcaaaggctgtcggatttcttttgtttgaagaaataagattgtaaatcctgtcatatttcttttgtttgaatcttaaaatgaacttgataaaattatttccctatactttaatcaatgacttccaaaatcatcattctcagtaaactatcgcaaggacaaaaaaccaaacaccgcatgttctcactcataggtgggaattgaacaatgagaacgcatggacacaggaaggggaacatcacacactggggactgttgtggggtgaggggagaggggagggatagcatcaggagatatacctaatgctaaatgacgagttaatgggtgcagcacaccagcatggcacatgtatacatatgtaactaacctgcacattgtgcacatgtaccctaaaacttaaagtgtaataataataaaataaaaattaatgacatagaaatcagagtaacactgtgcctatgaaatattttgattagtttggaagaaagtccttgtaatattttcttttaacaaaacaaacttttcttgtttgttcagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggtgattgtaggagttttaaaatgtaatttaaaagcttagtatcattttacatttatgtgctaggagttgtagtcagtagtcatggtggttttttcttttctggcttttaatgctgttacttttctcacaattgatcctcttataataataagaaaaaaccctggggtttagtgtttagtggggtttagagagaagctttgactagttttttttttttttttttttttttaaaccctcctgacgtgtgctttttttgtcggactaaaggaagcacagcgtgtgggttcagagaactggtgccagccttggactccctggctggctgttagagccggtgctgcccgcctgcttggagaggagggctggccagggtgtctccttgttcagggactccacttgtgtttccccagcctctggttgtgtggtctcaggtctacctgtgcaactgggttggtctgctgcaattgaaataatagtattttcactaaattgtcaatgattccttttttgttgtccaaaggctttcttaaccatatatatcaaggaatgttagtgaaattgttgaagagaatgagttacatcccagaaaaataccttctttaaggcactttttcttaactgaatcataaagacattatgaatgagatgtcttttttttttcctttaaagaatgagctgacttttgagttttaaaaattcatgttaagtgttatcttgcttattggtaacacttcctatattttgtgcacgcaggcagaacttcacgggccttttaacccttatgaactaaagtgccatagtttgaccagaatatccaaattcaggtatgattaacttaagttttccatgaattttttttctctgcttttctgtttatagatctcatcagaaaataatgtatctttatatctaaactgttggaatgtgttatcttttcttttcttttcttttctttttttttgagacagagtctcattctgtcattcaggctggagtgcagtggcgcaatcttggctcactgcaacctccgcctcccagattcaagcaattctcctgcctcagcctcctgagtagctgggattacaggcacgtgccaccacacctggctaatttttgtatttttagtacagacggggtttcaccacgttggtcaggctggtctcaaactcctgaccctgtgatccacctgcctcggcctcccaaagtgctgggattacaggcgtgagccaccatgcccggccggaatgttatcttttctaacttctcatttctctcccagctcctgatttgaggtagtctctctctcacacacgtgaaagccattctatgtaagacatttttgagtatcttttatcaaagactacatttttttctgttcttgttacaattgttattcagcaaagctgtgagagcccactgtatgccaggagcagtgtgtggtttggggcaaactgtagtgaacaagaaacagttgtttgtcttcatgaaaattatggatgcagttggcgggtggggggcatagaggaagccggtaactacaatatagggtgatagggctcttgataagggcacagaacatcatgaaagcatctagggggcccagccacccttgaaagatcatggagcttttccagagaaatctgaggcctggcggatacagaggcgtcagccaaggtgcaggtgttggaggaagagaggggaggtgggatgagggtggctccactggcaagtgcataggcctgagtttgagagtttgcacgtgtaactcgagtaagtttagtaagattggagaattgggtggggggaagggaggtgccaagcttgtggtagacgagggcaaactttgtagacttcattctgaaagggccgtgaaccttactatgtgcattttaaaatgatgcctttgggtaagtcttgtcttctcaaaatgtcttccggggagcacattggaaatgcagatgcccaggtcccctagggccttccaaatgagcctgcattttcacaaggcctctggcgatctgcctgtgcttacagtctcaggagccccagtgtgaagccggcattggatttcagagtagaaagatcctcaggcagtattgtgcttctgaggctggtccctgctgtaacccagggtgggaatatgggaaactgagtccctggcaggagatacagaaacagcttcaccagcactttcacctgctggaagcagcaggatggagctgcattagagtcagtgctgaagggaagaggaagaattaagggtgcccttgctggggctgcagcaggcttctgctgaggggtgacagaggaactgtggggtggaccacactcagttccctctgccaggatgcaggtgatggcccttatgagttgacagtgcaggacagagggtctcgagtggaggtggaggttcgggcatccccagcgtgtgcgtggttcctaagccaaggagtggtcgggatcatgcacgagggagtggagagagaagagggctgaggaccagcttgaggactcctgtgtgaagaggtggtccagtaaaaggagatgtgcaggagagtggggggttaaatatttcttcccgtctatcattgcagttgcccgtttgtatttttgaaatgggttgcttgtgggttggcatagcacattgcctggttagtggatcagtcaccccatctcctggtgctcctgccttttaggtgtgtttggattgagaaggagagcatcaactctgtcattatcagtgacgcccctgaagaccttcaccagagaatgctggttgcagcttccctttccatcaatgcgactggtaatttaaagatcctgtttattccttgtcctctcttttttcttttccttgacttcagctactaggaacaacttatcctataattggtgaacaagtctacactatgtactattctttttttttctttttttttttttttgagacagagtcttgctctgtcgcccaggctagagtgcagtggcgcgatctcggctcactgcaagctccacctcctgggttcacaccattctcctgcctcagcctcccgagtagctgggactacaagcacctgccaccatgcctggctaattttttgtatttttagtagagatggggtttcactgtgttagccaggatagtcttgatctcctgacctcgtgatccacccgccttggcctcccaaagtactgggattacaggcgtgagccaccgcgcccagcttacgtgctgttcttttaggccattttctgactgctttggctggtgcgaggttacgcggtggagcattctcacttttccttttatacaaggatgtgggaagtattaataattgactcctggatctttcattcattccaccctgcttggctacagagtagaatacatccaagctcttggccctgggaaaaatccaatagcctgattaggggaaagagatgcaaagagtaaccaaataggagttatccccaagtggggtaaaagcttacgcatcatagcgtagtgtctctctgtagggtactgtggaaacagagaacagggagtgtgcgttactattggggtgggcctgtggggactggacagactcagcagaggaggggatacctgcagatgagtaggagcgggccgggagggaacgctgccctgagcagcgtgagttaatgcccgatgttgatttagcatgacttgaacaggatctacgatgctgctgagagaaacctctctgatgcctcatatccctggcctcccggctctcctcagcatgttattcgcaccggtgatagagttaaggtacgggcatccctcttgtctataggctttgtaaaataagaacctgggcgggaaaaaacgggtgcctctccttgctccttttggaaagaaagcctttatggaagctagccatggcacgtctcgctgcttggggtgaagcctgtattgttattgatttatttatgcttgggctgattttgaaagaagctcagaaagcttgtaaaggtacacactgtgtcacataggagcttgaggcaaaaaaggggtaaaataaattaaaaatggagctaggaatgaggctcaaaataaatgtcatggtgatggacatcccattgttaatgggtggtgaatgtgattccaagttttctggtgaccagttgtcgacaagaacccgtcagtcccccttcttgtggtaaccatgacatcagaaggcagattgcccagcagattgtagctcttgttaatgccacgattaagccaggatttctcccagagactttgatagagaggagtgtgtgatgccatgagcagagctcttaaaggcaccctcacagtgggggctgctgccgtgtaaggttttgtttgcagactagggattgacagagcattctctgtggggaaagcactaacataggttttagtggagcagtgggtgggggtggctagaaaaggagtaatatttgggctttaggaactcacattctgctgggcaggatggaaatggccatgacgagattgcagtagaggcctggtagcacttcaagagtcgggggcatggaaagttacccttttcttcttttctagtcagctggtgagcatggaggggtggtccatagacctagagggctaagttcagtcaaggcaggtggaagggccccaccgtttactcagtcctttttgccattacacttgttcagaatctgacagtgcaatctcaaaatgtgtagtgcttttttttttagttgtaagaatatttttttcattaaaatatgtgctacttagaaaaagctgaatgggaaaaattaacacatttttaaatttatagatttaaatttaaatagtatacttattttaaatttgtatatacatatttttatttaagattcttgttatactgtattcttttcccacaaataccaggtttttcatattatgatatctttgtaaatatccattttgataattgtatcatatatcactgaatgggcatatgatggcttacaaaaataccgccctgttttaattatacatgcacttgtttctgagcggctcttgtctgaaaggattgaatatgcctttaattgttgaaatgtgacctaattttgcaatgatgatgcagtaaatccctctgtaagttcaggcgtcttggagcctcggtggggagacagatgtgcaggaaccacacgtggcagtgggatgatctcatgagcaaatagcacgctgtgcacctgcaggcctgaggcttggctagtgcagaagcaggtcccttcctctcatggcactttggacgccctgcttgcctttttaactagacaaagctcctgcttcacctcttttaaacaccagcttttgaggatttgaatgatatagtgtgttattttcacaactccagagtgcaagcgtttaggttgtagacattcaagaaatactgacatacttggtatttaaaacaccatctttctagaaaaagcacaagcttaataggaaaaggttatatataacaatacacagtgctttgctgattatattcattttgttgaattaactgaaatgtgccagatttgggacggtttatgtgacagtgtgcgtaagactagttgtctttgaatccacaggcttaactaggtgattatcggaaaggtagcaggggggcctggttgattttcctccaaactctgcctgcctctgagtagttgtataagcttggttttgttgttgttttttattttgttgttgttttttgagacagggtctcactctgtctctaaggttggagttttttttttttaatttgttgagtgagtaacaactgtttttgagaaactttgaaagatgacagctgtttgatttgggatgagcattctcctttcctttcactttaaatatgcagtcttctgcagcgagcaggaggggggtcttcagtacagaactggcccaggggtcccagcactgtgtcttaggtgtgttccggaggggagctgtcctccaaagcccacagctcctgcgagccgctgccccgccatgcgcccatgcccgtttgcttccttttgtgagccacctctctaatgcgcacccgcatgggactcgtctcctgttcgggtggcgtctggctgctgcactagaggctgtcctggccccccttgttaaacgcgaagcttgcagtctctgggtaaagtctgttctccctccacatgtgtcactgtcctgtcacaactgattcaactttacgactaagtgataattttttaccacctctaacatactctttgtacaatagtggcaggaaaggaagatgagcagaaaacttaattttatcttgattttcaatttaaaaaggggaaggagatatgtgttatgccccattcataagcagagacatctaagtggaggccactgtccccttctttgccaactggctgtggactgacctagctgccatttgtctcctctcctttgttctttctgccatgtgaccttcacttgtagttggcccctccataactcagggtgactgagccttggtgccagctttcctcttcccttcatcgtggagctgatccaccacacatctgtccccggagtgcgtcactcctcttgctgcccctgtcctcgaggtgttttccctgaacagttggagtagttgatggtgtcagcctggattcagtggcatcatcattgtgtaccttgtggagcccgcctccctgggtgagcagaatgctccatggtagcagagcctggcacctccaggatgggagcagacatctgagaacacgctcttattggtgtagtgacaagaacactgtactcacctccttcccttggttcttggagccaggttttgctactggggagactgccaaatgctggccatggtttagaggctaagtcacgtgttgagggcagtgctgtaaccctgggaagatggtgcttctgaacaggcatgagagggtggggggatctttaaacaacaacaacaagaagttctatcaattaaaacctaaaaattaatatctacacttatatgtacccacaaaaattaaacaaacaaaaaattgaatgagggtggattaaaagaagactctcactgtttaactgggttttctggctactgtggctaaaaacaagctaccccaaaacttcagtgggctacagcaaccttctttgcctctgtgggtgaggaactatgtcagggtacacagggatggcttgttgtgttcccaatgttggggcctccagctgaaggatttggaggctggtgggtgtccaggctcacatctggtggttgctgcttgccagagacctcagttgctctcagtgaggacttccacaagtgatctgtctgtaggctagtttgggtgtcctcagcatggtgggttggtgctgagggtcctgagaatgagccaggtggcagctgtccctgtttttttgtttgtttttttgagttggagtctcactctgtcacccagcctggagtgcagtggtgccatctcagctcactgcaacctctgcctccaagtgatcctcccacttctgcctcccaggtagctgagattacaggtgtgcaccaccacacctggctaatttttgtatttttagtagagaaggggtttcgccctgttggccaggcttgtctcaaactcttggcctcaagtgatctgcccacttcagcctcccaaagtgctgggattacaggcgtgagccaccgtgcccagtatattagttcattctcacactgctaataaagacatacccgagactgggtaaattataaaggaaagaggtttaattgactcacagttctgcacgactagggaggcttcaggaaacttacagtcatggtggaagggaaagcaaacacgttcttcttcacatggtggcagcaaggagaagtgccgagcaaaagggggaaaagaaaagccccttacgaaaccatgagatttcatgagaattcactcaccatcacgagaacagcatgaggttaaccaccctcatgattaactgccttccagagggtccctcccatgacacgtggggattatttaggatgagatttgggtggagacacaaagcttaaccatatcacctggcctgtgtcaccttttgtaatctagctgcagaagccacacagcgtgagttttactgtagtcacagtcacagctagaccactgtggcttctaggtcccactgtaattcacagtgtggttggaaactactgagacgccttaggcaagggagtaacattgtatttgttttgaaaagctactcctgtgtgctatatggagaaaagattggaagaggcaggagtaagagatggggaattggtcggaaagttgttaccaagtccaggtgagaaatggcagtggcttggaccaggctgttggccgcagccatggagaggctattagggagtgataaaggtgacaggacgtgccagtggtcagaggagggtggtgataaaactgggatacaaaactttgtaagtgtgcaccattgttttaggatgagaaggtggaacatttttttaggcttttactaagtgctagacttgtttgacaggtcataaatatgtacatagccctttctccagaaatctccctaataagaatttaacccatggaaagaattcgaaggcaagggaaaaaaaaacccattcatgataaaatattcttttcattatcttatctaccacattagaaacttaataaagtattaatacaaattattaagtattaataaaaatactgaatttactattcttataactatattttataactatattttgattgtgaaaactggcagaaaaatgcacaagtgaaattaattgctgtactagggctggcagaatttaggataattttatcggtcaatttttacatgctaaaacatatactttaacaattctgaaataatggactcttctgaaaacattccatttaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggtaagggtagtgcagcatcacggcaccacaaccctgtctctctctggttttgcttacctgacagtgagtgcagggtctgctgtggagctcgcggtgcagacacacacctctggtcctggagatgtgcacgttccttgtccctcctggagtcaccctccaggaggaccgctccttaacttgccagtttgatgtatctttcctgtgaaaagtaacttcctgatggtgctctctgagtctctcatttggtgtctcctggcataagcttttctgggcaatcagctaaaccacggggctgtagggctgctgtgggtctcattccaagtcaggaagtggaacatccttgctagttcttactgggaaaggaggacacaaggtcctgcccctctgcccttctcccggcctggtgaccatgctgagcagagggctgggtcagcgtgagtgcagagctgagctgcttgcagcattgtctgggcaccgcactagctctggggtgaggtggcaaggcagacagggaaactgtgtagcaagtacacaaagtatttgtatgtcatttgaatctaataatagaaatgtgggctcgtatttgtgtacattaaaaaagatctttcatcgttatagtaatttatttttattgcattttacaaagtgggaagaccaaaactgatcctttaccacaaatagtttgagaaatgctactttctaagtactcagtcgcctttctttcttagaagttccatgagacgggtgaggttaacataaccacactgaagggccgggggaaaggaggagctgcagagacagctgccgatgctccgggggcaggtatcagtgttgtctctgcaactgttaagtcataattgcctggtcacaagaaggggcttatgggcttgaaaatactccttaagccatagacctaatgggaaaatgtaaaactattaaagtgctacaagcaaattcaggaaatctgtgtgactttgggtgtggcatgagtttataaatacaacacccaaagcacaatctgtgaaggggaaattgatacgtttgaatttatcaaaattaaaaacttttgttccgcaaaagaccctcttcagaggaagaaaagacaaagtgcacaccaggagaaaatagttacaggttacatatctgatgaaggacttgtatccacaatatgtaaggcactcttaaaactcaattataagaaaacaagcaacagaattaaaatacggatgacagtaaacccatgaaaagatgctcagcatcatatgtcattaggaaaatgcaaattgagacttccatgagatagcaccacctacttactggaatggctgaaatccaaaacctgacagtaaccagcaatggcaaggaggtggtgcagggggaccggggaccttttgttcattgctggtgggaatgcagattagtaccactattttagaagacagtttcatatgaagttaagcctgcatctaccatatgacccaggaatcccatctgtaggtatttattcaagagatttgaaaactagcatccacatagagcttgtatgtgaatatcaattgcagcttgagtcataattgctaaaaactgggagcagtcaagatgccttcagcaggcgagtggataaaccatactgatgacagagaatactaactctgaatgctatgaattctctaacgggatgaaattcagttacgacggagccttatgagtgtttatgttgctgttcatttacaggttaatattctcagggctgctattaacaagctagtctgtgatggaccaaatggatgcaagtgtcttgggccagagagagttgcgcagcttcaagacattgcccgtcagaagcttttagggtaagctgtgtgatgacgcgggcttcttttcttcccagtcaactttctcagctgccttgatcatggctgttttgaattgtgtaggcaatgtgacatattgatcacctgaagtggagtgccagtgctggaggcagcactgggaggcatcagaatgtaggcacgcccttcctgtggagagcagcacccttgtcctgtgtgtgtgtgtcccttgaagggacagcgtgggcagggcatgggaagccacagtgggtaatgtgtcacccaccattcctagtggtgggtgtcttagggattgggggagtccggcttgtaggattgggccttacagagctgggcctctcttgaacctctctgcaggggaggttggagaaggagcattctgacctgacttccctgtttctcacctcctgctggactctccatgggacaaaccaaaccagaatgcagacacaaaaggctcctgttggtgtagcccatgagcccaaggcagcttgagggccccgggaaggccaagaagagtgggagtggtcatggaggagaaaccagcattccacctacccagtcctgtgctcctgccccagagccagtctccctgggaagggcccggtccttccttgcctgacagtgtcctgtgctggctgggacctggacctctgtgaaagcaggtggcatctggtatcacggtgacacttctctccttcctatgccttttgggttggtttcttttagtttaataagcattttttaaaaagctatatatagctgtcttagaaatggtgagaaaggccagttttagttttctctcttcattttcttttatataaaaatatttttaatatttatttatttatttttagagacagagtctcaccctcttgctcaagctgagtgcagtggtgcgagcatggttcactgcagctccaactccttggcacacatgatcttcccacctcagcctccctagtagcaggggctacaggtgtgcaccaccacacctggctaatttttaaattttttacatagatgaggtcttgctatgttgcccaagctggtaattttttttttttttttgagaatggagtcttgctctgtcacccaggctggagtgcgatggcacgattgcagctcactgcaacctccacctcccgggttcaagcgattctcctgcctcagcatccaagtagctgggattacaggcacccaccaccatgcccagctaatttttatatttttagtagagacaggatttcaccatgttggtcaggtgaactcctgacctcaggcgatccacccgcttcagcctcccaaagtgctgggattacaggtgtgagccaccatgcctggccagtaaaaatatttttatgtaaaatgtgggttgaagtttaagtacacaggtatatgcccatgtggccagcaccgaggtcagagccccggtgctccttagggtgtgcgggtgtggttgtagccaccatcactccctgcccccaaaacaagggtaactgtatcctgccttattatgccataggtagtaggtattggtttgtttgttttaacaattcaataactctagtgaatttatagttgtgcagtctgtcaacacaacctagctcttcagcatttctgtcatccagagaagtttactcataagtattgtcgggaaaggcagtctcatgcaggcagcctttgatcccctctctgctgtctgagaacaggccttgggcctgaaacgcttccttcccataagattaagggtcctcacagcctgtggggggctcgtcgccatgtgtgggaagatctttccttgattccggctctgccctgcttaagcctgtgtgtcatacggtacctggtcaatcccaccactgcagggatgggacagggctctcctgctgccacataagagaggggcctgcaggcctgccttgtcttccgggaggtacccgctggccacagggaccgctgccagtcactagagctgatcctgtcctgttgcctccctctgtaagtaaaggttcgttccagccagggtctgactgtgtgttttccttggcgactccaagacaagatgcaggggtgccctgacttctcctggcagcaggcagcagatgccacctgcttgactaatatattaaaacagaatgtgtcattgtttgtacaaccccataaatttactaaaactaatcaattatgttcctaaagttgatgacttttaggatatgtaaagtacacctcagtaaagctgtgttgaggatcgaaagttccccctgtccatttacacgcagtcttgttcccaccccagcccaggtaccactgatctgctttctgtttatatatttgccttctctgacatttttatatatgtggaatcacattttaattttaaaatctggcttctttcacttagcttagtacttttgaggtttatccatactgtatcatgttcctttttactaaataatatttcattgtttgttatgccacttttttaatccattcaccagttgataaaatatttggattatttccagtatttggccattatgaagaaagctgctatgaatagtcacatacagtctttttgtgaacatgtatttttctctcgggaagatatctatgagtggagttggtaggttgtattggtaggtttatgttaatcttttaagaaaaggccagggccagacgtattggcttacgcctgtaatcccagcacttcgggaggctgaggtgggcagatcacctgaggtcaggagttccagaccagcctggccaacatggtaaaaccctgtctctactaaaaacacaaaaattagtagggcatggtgacacacgcctgtaatcccagctacttgagaggctgaggcaggagaattgcttgaacccaggaggcggaggttgcagtgagccaagatcacgccattgcactccagcctgggtgacaacagcgaaactctatcaggaaaaaaaaaaaaaaggaaatagccaaactgttttccaaaatagctgtacaatgttacatttctaccagcaacataggctggctctggcttctccacattctcaccagcacgaggcaccggcacgtgttgttactgcagtcagtctggtgagtatggtagtatctcattgtagcattaattttcgtttccttaatgactaatgatgtagagcaactttttatattcctcttagccagtcatttatccttttttttttttttttggtgaaatgtctgttcagatcttttgcccatttttaaatttgtcttttcattattgagttgtagaaattgtttttaaattttagatacacgtcttttattggttaagtaatttgcgattagtttcaccattgtgtagcttgtcttcttattttaatgatgtcttccaaagaacacaaatttttaattttgatgaaatctacttgctgtggtttgaatgtgatatgtttgaaacctaatacccaatgcaacagtgttggaaggctgggcataataaggggttgactggactcatgtcatcattgtgagagagggttagttatcaagagagtatggattgttgtaaagtgggtctgccccggtgcctcttcctgtctcaagtactcacttgcccctctgccatgtcatgatgcagcaagaaggccctggccaggtgctagagccatgctcccgcacttcccagctccagaactgtgagaaatcaagttcttatctttgtaagtgacccactctctggtcttcagttataacaggggaaaatggactaagacactactttatcttttttttgagacggagtcttgctctgtcgcccaggctggagtacagtggtgcagtctcgactcactgcagcctccacctcctgggttcaagcgattctcctgcctcagcctcccgagtagctgggattacaggcacacgccaccaagcccagctgatttttgtatttttagtagagatggggtttcaccatgttggccagaatgatctcgatctcttgacgtcgtgatctgcccgcctcagcctctcaaagtgctgggattacaggggtgagccaccgcgcctggcctactttatctttttaaaaaatgaattatgttttcggtgctatatcttaaaaaatccttgttaaactgaaggtcacaatcattttctctctttttgtaattttttatgtttaggtttttgatccattttgagatgattttgtatgtggtatgtgatacaagagcctaaagtcattttttgcatatgaacatctagtggtgatgacatcatttactgaaaagctatacttttaccattgaattgccttggtaccttggtcaaaaatgaattggccataaatgtaaagatttattactgggttttctgttttgttcaattactttatatctatctttgtaccagtgctatactgtcttaattgctgtagcattagtcctcctgttttattctttttctttttctttttttttgagacagagtcttgctctgttgcccaggctggagtgcagtggcgtgatctcggctcactgcaagctccgccccccgggttcatgccattctcctgcctcagcctcctgagtagctgggactacaggtgcccgccaccacacctggctaatttttttgtatttttagtagagacggggtttcactgtgttcgccaggatggtctcgatctcctgactttgtgatccgcccacctcggcctcccaaagtgctgggattacaggcgtgagccaccgcacctggcctgctctttttcaaaattatttttactcttttatattcttttcctttccatgcaaatttttggatcagcttgtcagtttgtataaaaatccttgttggaattgtggtagggattgtgtggaacctgtgagtcagtttggggagaattgccatcctaacagtagtgagccatccagtccatgaagatggagtgtctgttcatttgggtattctctaatttctcttaatactgttttagaattttcagtgtgcaggtcttgcactttagttgtttctaaatattttagttcttttaatgctattgtgaataaaattgttttcttaattttgtttttgaattttttttagaaaggaacagttgatttttatatattggtcttttatcctgtgaccttgttaaacttctgtattctagtagttgtttgtagattccttaggatttcctacatacaagatcattattattatgaaagctttctttctctagtaatgcttcttgttttaaggcctattttgtctgatattaatatagctaccccagctctctttagctaccatttgtgagctttttctatccttttacttacagtatatttgcagttttgaattttttcaaatatttttttctgcctcgtgcccgctctcttctcccctagggagacattgctttgcacgtctgtcagtgcgctggtgttaaacgcgtgctgacacggtcgatacggcctcactggtctttgaggctctggtcactcttcttcagtctctttcctttttgtgcttcagattggttaatttctgttgatctgtcctaaggttactgatcctttattatttcatctcaggtcgacgtggatgcggtacagagaattttccatttcagtcattgtacttttcagctctaggatttctgttgtttctttggtagtttttaatttttattgagattatccctgattcattgttatcctatttttaaaaaacttcttggcacctgttcacagtggctgccttgaggtctttgagtgctgaacccacagctggccacacactcagcctctactggctgctcttctgtgtgtgggccacacattcctgtgtctttgatgtctcctaatttttttgttggaaattgggtactttagataatgtactggagcagttcccccagagctgctgtttttgggttttgtggttttgtttgtttcactttagaaaagtgcctagtcttaacctgtaagtccatcccctgtgatgtgaggtcactgatgtctgggttctgctgttttgttatgtttttaattttaatttttatagaaacaaggtctcactttgttgcctaagctggagtgcagtgatgtgatcatagctcactgcagccttgaactcctgggctctggcgatcctcctgcctcagtctcccaagtaggtagggctacaggcatatgtgaccacgcccagctcgttttgttttctttattcttatttttattttttagcctggcttcctaggtgttgtccttgtatctgatctgcacagcttagtgcttagccagtgatcaatcaaaagttgtctttaaatactgccctgaaggcttctgccctttgccattggagctaagtatgggttgaaaagtgcactccaagttcaggcactttttgattcttccctggcctctatttttctcagggcttcccaggtttttcccacgtgtgtgcacccctccatcagtcagggatgtgtggagggcctgctccccctctgtggcactctcctttccagagtctcccttttacctcctgaatagtctggtctgctgctggccccaagcaggatgtggcgtgaggctggaaagctatgggctttccccatctgtttccttcattgctgtttttactgacaatgctccaagtcaaggtgtgaggatttttccccctctgatccagatcacatagcctttatggccctgggagtgctgtggtgctgggttcaggggcaggtgtatggggtgggagcggctccctaccccagcaagaactccacatactccactgttctcacctggagctggcagtttgtcatgaatgaatgcttctcaacttgttgtttgcctttgcctttggttaatttccagagccttcaaatggttgttgttggtatgtatgtatgtatgtatgtatgtgtgtgtgtgtgtgtgtgtgtgtgtatgtatgtatgtatgtatacagttttgccttgttttatagttttttagtggggagaggctctgcagaactctttactccctcattgttcaaattccctatctttttaagctgatgatatttccaacttgtcatgattgcttgagagctaatggtacaaaatgtcctgttacatttcagagaacttgactcattcatgtggtgtgcagtgctggttgctaagggaacatagagacaagactaggtcttacagatctgtcacactccatttctttctgcttttgaatatgccatagattaaaatattttctgatcataactgcataaatgttgacctttaaacagtttattctagttccaattctgtgggaagcatataggatttaaatctttaaaaaaatcacagcagtgttttcagttactaatatataattaagataatttcttttttttttaaattagtttgttctgtcagtcaaaaccaagggagaagattgttcccaagtggcatgaaaagccctacgagtggaatcaggtgagtgggacgcaggctgctacatgagcagaggccacgtggaggaggggacaggccctgggcagacccagggttcagagccagggctggccgagggtctgagaggcagagacaggaggcaaagtggatggctttgggggccagctggcaaatgtctcagaccagacaggctgtttctgcacagtgtcttctatgtgatgtcccggcaaagagtcagacaccaggataactcactgcctgtgagttgggaaaaaaaggtatgagggtctggattgaaccttcctgctcttgttggtctttgtgaaatgcaccttggctgttccttccatgtggctggcttggtggctttcgggctgtactggttgttgtctttgtctgcttgagctgctgtcacagtgccaccacgggtaggggcttaggaacagcagacatttgttctcacagctctggaggctggaagtcctagggaaggtgccagtttgtgggtccttgtgaggacctctgagggacatctgcagatggccaccttctcactgtgccctcacgtgaaagagagacgtcctctcttagggcacaaatcccatccttggggtcccacccttgtgacctcatctaacccttatcacctcccagaggccccatctccaaataacatcacagtgggggttcgggcttcagtgaaggaattttcaggggccacagttgagtcatgaagaaggacaaagcccttcataggctccctggtacttcctgtctgtagggctagaaatggaataaaatgtgatttcagagaaaggagcccaaaggagtttggagatttaattccagagccagggatatctctagatacaaagcagcaggggcagtcttcccctcccctttgacgatctaagtgaggctctgccttggaggactgtgtcccatcctgcgcctcaaggttgctcctgctgtgaggctcgcctgctccccctgtgccctgtgcctaggtccctctttagagaccccaaggctgatcctggcagccggccccattgtgtgcagagctccatgggcaaggagaggggcggccacaccagcccccatggccatcaggctcggttggagtgtctgagggtgacgaactagcaggactttgtttgaaaacagaatttcactttgaggttagtatgttttagaaaatttcagtgtcttcaagacctgtaatgcaattaccatccacatttacataggcatgcatgggagatttctcagtaaagcttgccatagtattaatcatgaatttatttatttgcagcttttattttagattcaaggggtacatgtgcagcttttgttacttgggtaggtggcataatgctgaggtttgaggtacaattaatcccatcacccaggtactaagcatagtacccaataggtagcttttcaatccttgcctccctcccccatctagtggtccccggtgtttcttgttcccatcttatgtccatgagtactcaatgtttagctccacttttaggtgagaacaggcagtatttggttttctgttccagcatcaattcgcttaaggtaatggcctccagctgcatcccgattgcacaatttcattctttttaatggctgtgtagtattccatggtatgtgtgtaccacatcttctctatccagtccactgttgatggccacctgggttgattccatgtctttgctattgtgaatagtgctgtggtgaatatgtaaatgcatgtgtctttttggtagaacaatttgttttcttttggacatatactcaagtaatggaattgctggatcaaatggtagttccgttttaagacctttgagaaatctccaaactgctttccacagtggctgaactaagttgtattcccaccaatggtgtataagcattctcttttctctgcagccttgccaacatctgttgtttttttgactttttaataatagctattctgactggtgtgagatggtattttgtggttttgatttgcacttctctgatgattactgatgtgtggagcatttttaaatgtttttggcccttcagtgtcttcttttgagaagcgttcatgtcttttgtccatctttaatggggttatttaaacatgaaattaaaaatgaattatcaaacctatagtatgaagtgtgagagtagagaagtgttctgtaaatatttttggagaactgaattatactttgtgcatcctggatgttaatgcatgtgtattttatgtctggaaaagccctgtcacagagcctgactggtccgcttgtctaccccattaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaagtttctgtttctgacagtttttagtcagaggagattaagatgtatttagttccaaaaaatctgaaattgtacaactgatacagggatacagacctcttttaaaagctcaactcacatcagtcagggtttggtcagaagaacagagctgttgtaaatacagcagtgaaagacgccagtgagctcgcacgtgagagggaagttgtaggatcagagaaatgctctgcttaaactgacttgtcccagatggacaatttgaagatggtgaggaaacaggagaagcgtgtgcatgggcatcaacttgggatcataaacgggagcttgtgtggggtcttggaagccgtcacatcttggggagcattggcgctgtgctgggcctctgtgggttcgctggccagcagcgggaagctggcagatgccaagcgggaagaccaccaagcagctgtggtggctgggcagcactgcacccctgtcactgggccactgtcctggccttctggggaatgtgcttcccagccttagggagtaagtggtcataccaagttggcacacatggagggctcttggaaggttttgagcacgtccaaaacttggttccgctttaaagtgaaggttttgcccgtcgtcagaaagccctctgagaaagcctccggggagggcagcagacactttgattggcttttctctttgctctgccgacctatgagtacttagtccatgtgggcaaggttaccaaatgtgtggccttagcagtaggggacactcacaacagtcaagcactcattctgttcgttttttaaccagacttttagtaagtgactaaaaatttaggccaggtgcagtagctcacacttgtaatcctagcactttgggaggccgaggtgggaggattgcctgagcccaggagttcaaggctgcagtgagctgtgattgtacccctgcgctacatcctgggcaatagggcaagactctgtctcaaaaaacaaaaacaaaaaaatttaagtagtaccaagaggcttgtttaaaaacaaaaacacccaactctcaaaggaaaccatactaactcttccctatatttttctggaattgctttcatcttgctgaggaatgtttttgttctgctttttcatggttgccatcttagccatcagctgttgagcagcagatgaatattggctccttcccactgttctgcacctcctttgctatctctacgcacggtcacagcaatatcactggccaggtcagtcattgtgctttataacgtggattttgtagatagcaaagaaaattatcttctgtaaaaccaagtggtgcacttcgactgcattgccttccttatctatcttaagagggtacttgccttgtttgtttgcaaaattctcctcatatttaaatacataataatgttcttagtataataatacatgtccatgacataagatgaagacatttgaaaagggtctctagtgaagtctctttcatgcccagcccaagtgctcctcggaggcagtcgttgtttcatcctggtgcatcccgtcagcacgccctgtgttccacacactgtcacggacgctgaagatccactccgagcaaagtggcccaggtttcactgcactcagggagcagtgggtagaggcagatggtggtcaaatgcgtcaggcgacagagtgagagctgtcaagcggcaggacaggagcgtgcacacttgtttttgctttgtgggccatgtggttgctgctgctgctgttcagctttgtgttgaagctcaggagtagccataaacaaacgagcagggctgtgtgcccgcaaaacctgatttatgagaacaggcatcagacttgagcttgggtcttagctgctgatcctgtgatggggggaagtacagggagtgacactgctttagagaagcagctggggacagcctttcccatgtgacattcaagcagaggcccggcccaggctgcactggaatagctgggaggagatgcgtgaggctccaaggaggcagcaggcctggtgcgtgtgaggagccaccaggcagcccgtgcggctggcacagagtgtggagggtactggtggtcaggctggagagcagccaggccaggtgggccacacgcaggttttggggtttactctgagtgaggtggggagctcctggagggttttgaacaagggagtgtcatgccttgatgacgttttgagaaagattattctggctgctgcatggggcatagggtgcaaaaccagcacagttaagtccaggaagaaacactggcgtgcagcaggggtgggagcagtggaagggcagggtggccagacagaatgtgcaccagagagacagcagagtgaccagaggcaggcgtggcaccacggctcagaggagaaggttcttggaggcaccatggtggtgggcagagtgttgaccccctccctggacatagtctggggctgtgtccatgtccaaacccccacaactccctataaatgggaccgtatttgggaaaagggtttttgccagtgtgactgagttaaggatctcaaaatgaggtgattgtcctggatttaagatgggacctgaagccaatgacaaatgtcccgatagaggagaaggccagtgaaggcagaggctgagattgcagcaatgtggccacagccacggaagacctggggctgctggaggctgggagaggccaggccaggctctctccagtgccttcggagagaatgtgggccctggatgccttggtgtgagaattctggcctccagaactgtgagaatccatttctgttgtaagccccctgtttgtgcttatgtgtcctggtggccccaggaagagaatccagccagtgtcttcggggtcctttcggagctcctttcttcatatatgggcacaagcctcttcattttcatgagtcgttgcatactgcacatgctgatctctaccttgacttttcactgattgttgtggattgcactgctagatcctgcacaaagaggtgcctcattctttttaagtgcttcatggttatatcattttgttcatgtttcataattaatgacacccctgcaacgggcatttggatagtttctagtcttactattatacacagtgttgcagtggatgtccttgtacacctgtcatttcacatgtgtataatttattatagaataaattcctaggattgggattactgagtcagagggcatttagtaaatcactcccttcctagatgttgccacattgctctccatagagcacacgctccccccagcactataggacagtccgtacccagactctcaccctccgagttaggacagtgttggacacttgggagatgccctttctctctggcaggtgagtagtcttgagtttctccttatgagtggcctgagcatcctcagatgctgaggaccattggcttctccttgtatgtgaactgtttgtatcttttgccaggctttctttgtgttaaaattgatcttgttatgtagtttagtttatgaatttttatgccgtctcaaaaagtgtctcccctagtttgagattattagaattctctcccatatttacttctagtactcttatggtttgattttgtacataaaatttactgaggtaaaatttacatacaaggattgcaaaggttgcctactaggtgttctttcagaatttccatagttttagcttttatatttagggctgtgacccatttcaagttttatttttaattttttgcttattttgtttttttggggggagggggatcagcggtgatgagaggttgatttgcttttccatacattttttgagaagaatatactctgaccctaaattcaattaccttgaaaactttgtaaaaaatcagctgaccatatagggtcacaattggattctcttatgttacactggtttatatgtctgtccttaaaacagtaatgccatacaatacaatattgattattgcagcttaaaatgctaagccttgaaataagattgtggaagtcttccaaatttgtttctttcaaaatggttttagtattctagatctttaccttgccatataaagtttgggctcagcctgtgaatttttacaaaaatgccagctggaattccaattgagattgtgttgagtctgtgactattcagggagcacatcttgaaaactgatgaacaaggtatctttcaccatttacttaactcttctttagccttctcttactactgttttattcctaggtatttcgtgtttttgctattgtaaaagttattttcttttggcattatggaaattttcaaacatacagtaaagttaattttacagtgaacatcaatatattcactacctagattttacattaccactttacttgttttatcacttatttatcaattcctctattcttcagtccatctttttgatgcatttcaaagtaaacttgacagcattacacttcccctaaatacttcagcatacatattaaccgcagtgttttcttttttttgtgacacgtatatgcgttgaaacatgtaaatcttaagtttatccagtgagtactggtgaatggaaccaaaccccaagatacaggacgttatcatcacctggaaaattctctcatctcccttcctaggcagcctctcactcacagataagcacccacagttccgagtattttctccacagattagctttgcctgttctagaacttcagttaacatattattttttaaaagttgattaacacacctcattgttttaaggcagttttagttttacagaaaaattgagcatatagtaccgagagttcccctgtgcctctctcttctctctcctccacacagttcccctattactaacatcttgtgttaatgtggtacgtttgttacagttgatgaaccgacattgatacattgttaactaaagcacacagtttacatcctcagggtttactctgtgttttaccttctgtggattttgacagatgcccgacgtgacatgtctaccattacagtatcatacagaatagtttcattgctctaaaaatcttctgtgtgccacctgtttatcctgccccccattcccttcccattggccaccactcatctttttactgtctccagagttttacccttttcgaaggaatgacatatattaatagttcaaatcatatagtatggaaccttttcagactggcttctttcccttagcaatgtgtatttaaggttcctccatatcttttcaaggctcactaactcatttttattgctgaataatattccagcaataaaaattatggatgctaattggctacttgcatttatggatattaatgggctacttggctatttccagtttttggcaatttgaataaatctgctataaatatttgtgtgcaagtttttgcatagacattggccttcagctcatttgggtaaatactgaggaatgcaattgctggatcctagggtaagagtgtgtttagctttgtaagagactgtcatactctcttcaaagtggctgtaccatttcgtattcccaccagcagtggatgaggattccttttgcttcatgtcctcatcagcgtttagtgtgagtgttttggatttttgccatcctaatagatgtgtagtggtattttattattgttttaatttgcacttttctaatgacatgtgatgttgagcatcttttcatatgattgtttgccatctgtatatattctttgatgaggtgtctattcagatcttttccccatttgaactgggttgtttgtcttcttgttgagttttaattaagagttctttgtatattttgaaacaatctttatcagatttttttttgcaaatattttctcccagtatgtggcttttcattctctttatgcctttcacagagcagatgttttttcatttttttttttttttttttttttgaaagagagtctcactctgtggcccaggctggagtgcagtcgcatgatcttggctcactgcaacctccgcctcccgggttcaagcaattctcctgcctcagcctcccgagtagctgggactacaggcgcccaccaccacacccagctaatgtttttgtatttttagtagagatggggtttcaccatgttggccaggctggtctcaaactcccgaccgcaagtgatccgcctgcctcaacctcccaaagtgctgggattacaggtgtgagccactgcacctggctgatatttttaatttcaataattcccaagttaacatgtttttcttttataggtcatggtttttggtggtaaaactaaaaacttatcaaatccaaggtcacacaggtcctatgttttcttctagaagttttatggtttgtcattttacactaaggtctatgatccattttgagttaattttgtagaaggtgtaaggtctccgtctagatggatttttctgtatgtggacggccagttgtttcagcaccgttggttgaagagactgtcttttctccattgaattgccttttgctcctttgtcaaagatcaattgactatatttgtgtggacatgtttttggggcctctattatgttgcatttgtctgtttgtctatttttcaccaataccacacagtgttgattatggtagctttatagtaagtcttgaagttgggtaatgttgatcttttcttcagtactgtgttggctttcctgggtctttttactcgctacataaattttgaaatcagtttaatatcacgaaatatttttgttgggattctgttgaatctgtagatcaccttgggaagaactaacatcttaataatattgggtcttcctatcccagaaagtagaatatcacttcatttccgtagatctttggtatctttcgtcagagttttgtgattttctgcatatagatcttatacatattttattatatttatacctaagtatttctctttttttggtgctaatgcaaatggtactgtgttttaaatttcaaatttcagttgttcattgctgtaatataggaaagcaatggacttttgtatattaaccttgtatcctgcaactttgctataatcccttattcattccaggaggatttttcaaagtagattctttgggattttctatgtaaacaatcataccatctgcgaacaaagatagttttactttttatttccttttcttgtcttactgtattagccaggacttccagtacaatgtagaataggagtggtgaaaggagatatccttgccttatttctggcttagcggtaaagatttcagtcattcttcattgaggttgaatatgatgttggttatgggtttttcataaatgacctttcttatattaaggaaattcccttttattcctagtttgctgagagtttttaaagtcatgggtgggttttggattttgtggaatgctttttttgcacctattgatatgattgtatgatttttcttctttggccttgctgatgtgatggtttacattaattgatttttggatgatgaaatagcttgcataactgtaataagtcccacttggttgtggtgtataatttttaaaaacattgttggattctatttgctcatctttgttttattcgctactctttgttgaagatcttgttgaggatttttacatctaggatcatgagagatacttatctgtaattttcctttctggtgaagtctttatctggttttggtattagggtaatggtggccttctagaatgaatttgaaaatattccttctgcttctattttctggaagagattgtagataattggtatgctttcttccctaaatgtttggttgaattcaccagtgaaaccatctgggcctagtgctttcttttttgtaaagttatttagtattgattcagttttttagtagatgtaggcatattcagatgatctgtttctcattgtgttagtttttgtagactatgtctttcaaggaattggtttatttcatcttaggtatcaaacttctaggcatatagttgcaaataatattttttaatttcccttttaatgcccatgagatcaatagtgatggcccttctttattttctgttattagtaattgatatttcttgactcttcttggttagcctggctagagttttataaattttattgatcttttcaaagaacaagtttttggtttgatcaattttagttttacctgtcttcggtcttatgatttctactctaatttttatttctttttttttcctgcttgctttaggtttatattgctcctcttttctgtaattgcctaagatggaagttcaaattcttttctaatatatatatttaattttataaatttccttttgagtactacttttgccacatgccataaattttgaaaagttgtattttaatttgcgtttagttaaaaatattttaaggtttttcttaagccttgttttttgacccatgtgttatttagaaatacatttttaaatatccaaatatgggatttttagccatctttttgttattgatttcactgtagtctgagagtgtactttctatgatttctattaaatttattaaagtgttttatgtcccagaatgttgtctaccttggtgaatgttccatgtagcttggaaagaatgtgtattctgctcttgttggatgaagcattctgtaggtgttgattagatccagttgattgatgatgctgttcagttcaacggtatcctcactgaaatttcacctgccagtctgtcaattactaatgcatgttgaggtctccagctataatagtggattagtctatttctccttgcatttccctcagtttttgcctcttgtatttggacactgttgttaggcacatgcacatttggggttgttacgtcttcttggagaattgacccctttatcattaggtaatgcccctctctaggccttctaatgtccttagttctgaagtctgcttgtctgaaattaatatagctactccagctttcttctgatttgtgtgttagcatgatgtatctttctccatctttttacttagttttaaattgaggtgaaattgatataatttgattaaccactttaaaatgtgtaattcaggcatttattgtatttgcaatgttctggaacactctgtagtttaaaaatgttttcattatccaaaaaggcaccttattaagtaagtacttaccagttaagtaaccattttcccttttcccttccctttcccccataccctggtaacaatttatatgccttctgtccctatggatttacctattctggatacatcatatacaaggaatcatacagtaggtgaccatttgtgtctggctgccctgacttcacgtaatgttgtcgagtttatccacgttacagcgtgtatcagtggcttgatcctttatttaggtggataatatcctgttggatgtggatgccacagttggtttatttactcctctgttgatggacatttggattgtttcagactctgggctattatgaataatagtgctataaacatttgtgtacaggttttggtgtgtacatgttttttcatttctcttgggtgtatacctaggaggaagattggtaggccatgtggtaactctatacttaacttttggaggagacaccaaaccggctgcaccattttacattccccccagcagtgtctgaggattcccatgtctctacagctttgacagcacttcttagtttcccccttttttaaaaaattaaagccatcctaatgggtatgcatatattattgtggttttcatttgcatttccctaatccccagtgatgatgatcatctttcatgtgcttgttggctacttgtgtatcttctattgagaaatatctgttcaagtcctgtgactatttttttttttttgagacagagtttcactctgtcacccagactagagtgcagtggcacagtcacagctcactgtagcctcaatctcctgggctcaagtgatcctctcctctcagcctccagagtacctagggctacaggtgtgcaccaccatgcctggctgatttttttttctttttggtagagaccaggtcttgctgtgttgcccaggctggtctcaaccccctgagctcaggcaatcttcctgcctcagcctcccaaagtgctggaattacaggtgtgtgaacaaccacacctggccctagtggctatttttaaattgagttgtcttcttgttgagtgctaggagtgctgtatacattccggatattatactcttatcagatatgtgatttacaaatattttctcccattctgtgagaatcctcccaccaaagtccaggaacagacagccccactaccaaatgttctgtgaaacattaaagaagaattaactccaatcctgctcaaactcttccaaaaaatgaacagaagggacacttcctaacacattctgtgaggccagcactaccctgataccaaagccaaagatactgcaagaaaactacagaccgatatatatatatatatatatatatatatatatatataatatacatttatatatatttatatttatattttgagacagagtcttactctgttgcccaggctggagtgcagtggcacgatcttggcttacttcaacctctgcctcccaggttcaagcaattctgcttcggcctcctgagtagctgggactacaggtacgtgtcaccacacccagctaatttttgtatttttagtagagacgaggtttcaccatgttggccaggctggtcttgaactcctgatctgtgatccacctgctttggcctctgaaattgctgggattacaggcatgagccactgcgtccggccaaaccgatacttttatgaatgtaaattcacaaatccttagcaaaatgctagcaaccaaatccaacagcacattagaaggattatacaccacagccacgtggtgtgtgctgccctaaagtctgtacgccgtcactccagtgggggacagaatcctgcctctcgtcttttgatgtccatctttagaaacccttccctgccaggagacaagggagtatgtggaggtctgggtgctgggacttcctgaagtgtccagaaccactaagatgtttgatttctttatttggccggatgctttttcttggtggtggtaataacttagcagtgaagttgtggaagagtgagtaccacagctttctttagagattaatactagccagtgagaagaactcagtggtgcagaacctggtatttttgaagccagatccttcacactgttttccttcttaaaaaaaaaaaaacagctttattgagatataattcatataccatataattcacctatttaaaagtgtcctgtccagtgattttagtatgttcacagtgttctgcagccatctccacaatcaacgttagagcattttcatcactcgagaaagaatctctggaaccatttgaggtcatcccagtttctccctactccacgctttccccgccccagcctcacccttgtccccaggcaatcacttatctgctttgtctttgtattttgcctgttctgtctctatatacatgcctgttctggacgtcccgccccttgtaattatatattatctgttgaccaacatctttccccgttggactccctgcaaccgcccaagctctggtaaccgccattctactctgtctgcctatgagatcagctgttgtaggttccgcatgtgagtgagatcatgcaggatttgtctctctgtgcctatttcatccaacttaatgttctccacattcatccatggtgtcacaaatgacaagatttccttctttttatgtatgcttattgtttttctgtagagtgaaccccatctcctgccaggcactgactggcaggtttagtgtttttgttggttttgttttgccaagggagtgggaggcaggtggtccactgggcctcagcttgtctccttgtcttcagctctgctgaagggcacttcaccaccttgtcctcggtacttggtgcaaccctcttatggcttacccaggaggtagatacagccccgtcgttgatatcattcctagtaaacgcagttggtagaaaacacaaaatacagcagacaatgataacatgtattatagaaagctgaagaattacatttaatggtgacattgaaaacggttagaatttatctggggaaaagtaagcttgacaggaataatcctaaaaccacagccagtgacagtggttactgtctaaaaatggagagaacagccatctttgtaaaatttgacccaggaaaataatggctcccaaagataatccgtacacagatgctctcaccaaaaaacacataggcagaacttgcctccccaaagcttgtctggaagataattaacctgatgaaaaatcttttaggaaattttaaaaagaaaatataaaaagtagaaactactttgtttagaaaattgagcaaagaagtatactgacttggtgaaattcatttaagaaaatactttttcagtgaaaattcatcattcgtataatgctgattaatatgttttaaacttaagtgggcggatcacctgaggccaggagttcaagaccagcctgaccaacatggagaaaccctgtctctattaaaaatacaaaattagccgggtgtggtggcacatacctgtaatcccagctacttgggaggctgagacaggagaatcgcttgaacctgggaggcagagcttgtggtgagccgagattacacgccattgcactccagcctgagcaacaagagtgaaactccatctcaaaaaaaaaaaaaaaaaaaagagaaaaaatgttttaaactcacactttgtcagaaatggcaggtgtattagtctgttctcgcactgctataaagaactacctgagactgggtaattaagaaaagaggtttaattgactcaattctgccagctgcacagaaagcatggctggggaggcctcaggaaacttacagtcatggtagaagggcaaaggggatgcaagcaccttcttcacatggaggagcaggagagagagagtgaagggggaggtgctacacacttttaaacaaccagatcttataagaactcactatcacaagaacagcaagggggaaatctgcccccatgatccaatcacttcccatcaggtccctctcccaacactggggattacaattcaacatgagatttggatggggacacagagccaaaccatatcattctgcccctggcccctctcacatcccatgtccttctcacatttcaaaaccaattatgccttcccaaaagtccttcaaagtcttaactcattccaactttaactcaaaagtccaagtccaaaatctcatctgagacaaggcgaatctcttccacctatgagcctgtaaaataaaaaacaagttagttgcttccaagatgcaatgtgagtacagggattggttaaatgctcccattccaaaagggagaaattggccaaaacaggggctacaggctctatgcaggtctgaaacccagcaggtcagtcattaaattcctaaagctccaaaatgattgattctttttactccatgtctcacatgcaggccatactgatgcaaagggtgggttcccaaggccttgggccgctctgcctctgtggctctgcagggtacagcacctgcagctgctttcacagcctggcattgagtgcctgtcgcttgtccaggcacatggtgcaaactgttggtggatctaccattctgggttctggcagatggggacactcttctcacagctccactagggcagtgccccagtggggaccgcgtctggaggctccaaccccacatttcccctttgcactgccctagtaggttctccgtgagggcttcacccctgcagcacacctctacctagacatgcaggcatttgcatacatcctctgaaatctagacagaagatcccaaacctcaattcttgacttctgtgcacctacaggctgcatgggagcccaggctgacttctgcctggacatccaggtgttcccatacattctctgaaatctaagtggaggctcccaaccctcaactcttgtcttctgcgtacccacatgcccaacaccacgtggaacccaccaaagcttggggcttgcaccctctgaagcaatggccagagctgtaccttggccccttttagccatggctggagctgagagtgtcggggacacagggtgccatggcctgaggctgcacagagcagtggggccctggatctggcccacaaaaccatttttccctcctagtcctccaggcctgtgatggggggtgcggcagtgaaggtctctgaagtgccctggaggcatttttcccattgtcttggctattaattaacatttggctcatcttatgcaaatttctgcagccttgactttttccccaggaaattttttttgctgcataatgaggctgcaaaatttccaaacttttatgctctgcttcccttttaaatgtaagttctagtttcaggtcatttctttgtttatgaaaatgagtataggcttttagaagcagccaggccacatcttgaatgctttgctgcttagaaatttcttccagataccctaaatcatttctctcaagttcaaagttccacagatctctagagcagggacatgatgccactggtctctttgctaaagcatagcaagagtgacctttactccagttctcagtaagttcctcatctccatctgacaccacctcagcctggacttcactgtccatataactatcagcattttggttacaaccattcaacaagtctctaggaagttccaaacgctccctcatctttctgttttcttctgaggcctccaaactgttccaacctctgcccgttacccacttccatccaaagttgcttccttattttcaggcatctttattgcactgccccacttctctggtaccagttttctgtattcatttgttctcacactgctctaaagacatacctggaactgggtaatttattgataatagacatttaattggcccatggttctgcaggctgtacaggaagcatggctggggagatctcaggaaacttagaatcatagagaaaggtgaaggggaagcaggtacaatcttcacatggtggagcagaagagagagggtgaagggggaggtgctacatccttttaaacaaccagatctagtgagaactcactatcacgagaacagcaagggggaatccacccccaggatccaatcacctcccaccaggtccctcccccaacattagggattactgtgcaacatgagatttgggtggggacacagagccaaaccatatcaacagggttgtgattttggagtcagggtgccttgtagatggagtttcctaatttcgaattgctgcctcttctcttattcttcaccctgcagccataggttttttctcaatgcacctctgagcagcagcaggtgtacgaggcctctagtcaagcctggatgtgctcctgcagctgtcttgtgaacttcacctgtagccagaatcattggccaagccccatgtagatgccgtgggaaaatcatatgtggctatcagcggatactgaaaagggatccatttgaggttcagcacccattcctaacttaaaagaagaaataaaacatgtaaaatagaaataggaaaaagctacagtagtttttgcattgcatggagggccagcatcataaaaatggtggttctgcaagccgaaactgtgcagagcaatcctactgagaagcagctgctccatcacctgtgaagcagtacagtaaaaactcccactgtttgttattggttacaaatgtgtagagaaatgaaaagagcagtaaaactaatgtatttagcacactgtgatttgaaacactagaaacattgggattaaagcattttgtctctttctaaagtcccgtcaatagtagtttaaacagcacttgccgccactgcctcttcctacaacttccgcttctgggcttctggccgagcatcttctccggggcctgttgagttgccacgctcctttctagttggatcggcttccaacactgtatcatttgcacatcccgtgttgcaaaatgcctcccagagttcctttcatttgcggttttttgctggcgtcacacccccgaggctgtcttcatccttctcgtcacaactgtttgctcattgtgaagattaatactgagtgtcaacttgattggattgaaggatgcagagtattgatcctgggtgtgtctgtgagggtgttgccaaaggagactcacattgaatcagcggattgggagaggcagacccaccctccatctgggtgggcaccatctcatcagctgccagcgtggctaaagtaaagcaggcagaagaaagtggaatgagagagacttactgtcttccagccttcatctttctcccgtgttggatgttccaagttctttagcttttgggctcttggacttacaccagcggtttgccagggactcttgggcctctggtcacagacaaggctgcactgttgtcttccctgctttgagggttttgggactcggactggcttcctggctcctcagcttgcagacggcctattgtgggacttcaccttgtgattgtgggagtcaatactccttaataaactcccctttgtatatacgtacatcctattagttctgtccctttagagcaccttaatacactcatttacgcagacaggctgccccctctcagcctctctggctgcaccgctggagcccctggttggcagcagcgtccacgttccctccctcagctgttttctctgtgacctcacttaggtttcattcaaatgtcacttccagggttgtcacatttcatttctttgctgcattttcacctttgtgggttggttccctctttccattttcataaactgtcgtgtgggcttatcactgggaggcaaggaggcaacaaacttttctgtgtgagctgaataacaggtgctcagtgatcaattcctgatgggctttgaaagaagtgtcgggatgggttcctgatctgatgcacacctgtgatttgcacatttgtgggttgaagagttggcagcacagtttactcttcgtgcggtttctcacggttgtatgccagggagaccggtacttgaattgtgctgttgggggggggggctttgttactgaactatggtaacagaaatgcgtgcatatcacagctgtgtaaagtaaggactacccatactgaaatgtgatgaaaatcaaaaaataatggtaaacgttcttttaagtggcaaaacattaaagccatttcagttaaaattagaaactggtcagggatgtgtactcttcctgttacttaacaatcacttgaaggcccgaaattataatgagaaaagaaagatgaaataaccgacgtaacattagacaagaagagagaaagctctttttgctgctctgatgtgtacacgtgttgaggatacccaagtccaccccaggttcagtaattcaccaggacttgtaggacttagcatgcagttgtgctcatgggtgagatttactatcgtgaaaggatgcagagaaaatcacagggaaaagacacgggatgaagtccagagaaaatcaggtcctctgctgggggagtcacacaggacattcttagtttgtccacagcatgttgtgataatgtgggtgaagtgtgtgtgccagggaagctcatcagaatctcagtgcccatgtttttattggggactggtcatgtaggaaccctctgcctagcatgtgccaaaattacagactcccagttcagtgtagaccacattgtttgttcaaatagttgaggcacagtgagacacccatgtcagagaatggtgggaaccctcctaaaattcaggctcccggctgccaatcaagggccaactttggaagcagacctttctaaggagtgcaatcttgggcttgctgtgtgaattctttttctgcataacctagaagaccccctgctataataacatattttgctaaggcttctggatataagctaaagatacaaaagccatgggcttctccgctgtggcaataagaacctagcaatggagaaaacattctgtgtggccaggcgcggtggctcatgcctgtaatcccagcactttgggaggccgaggtgggtggatcacgagggcaggggatcaagaccatcctggctaacacggtgaaaccccatctctactaaaaatacaaaaaattagccaggcgttgttgcgggcacctgtagtcccggctactcgggagcctgaggcaggagaatggcgtgaacctgggaggcggagcttgcggtgagccaagattgccatatggagttttaatgcttatgtactcaaatatgtttgtatctttttacatggcttctgattttccaatctaggttaatattacctaaaatgtgcatacagtagaattctattcttaggcatttattcatctccacaaattttaagatactttttatccaattcccaaaagacactgttgagattcactgcactccagcttgggcaacagagcgagactccatctcaaaaaaacaagcaaacaaaacaaaacaaaagacattctatgtatgtggtgaaaaaaaataagatgttttagaataaaggtgtaggacctatccctaagtgaagaaaactgagatcttattgaaagacataaaattggccaggtgcagtggctcacgcctgtaatcccagcactttgggaggccgaggtgggcagatcacctgaggtcaggagttcgagaccagcctggcctgacgtggtgaaaccccatctctactgaaaatacaaaaattagctgggtgtggtgacatgagcctgtaatcccagctactcaggaggcagaggcaggagaattgcttgaacccaggagatggaggttgcagtgagctgagattgcaccactgcactccagcctggatgtcaagagcgaaactctgtttcaaaaaaaaaaaaaaaaaaaaaaaaaagacgtaaaatccagatggctgaaaaagcgcagctgagaagatttcatataacttttgtcaactctcccaagttaatacgaaaatgtaattccaattagaatctcaacagtgtcttttgggaattggataaaaagtatcttaaaatttgtggagatgaataaatgcctaagaatagaattctactgtatgcacattttaggtaatattaacctagattggaaaatcagaagccatgtaaaaagatacaaacatatttgaatacataagcattaaaactccatatggcaaaagatacccatgtttggcgatataacattttaaaaacctcatatagcaaaagataccataaccaatcagtggataggttagattgcatagattgatgtaaacaacaaagggttaatatgtatacacaaaaacctttttaaaaattgtcaggcaaggctgggagtggtggctcacacttgtattcccagcactttgggaggccaaagcaggagaattgcttgaagtcaggagttcaagatcacagtaagacctgatctctttctctctccctcttttttttttttttttaagatggagtctcactctgtcacccaggctggagtgcagtggtgtgatctcggctcactgcaacctctgcctcccgggttcaagtgattcttgtgcctcagcctcctgagtagctgggattataggtgcccaccaccacgcctggctaatttttgtatttttttttagtacagatggggtttcaccatgttggctaggctggtctcgaactcctgacctcaagtgatctgcctgcgttggtctcccaaagtgctgggattacatgtgtgagtcaccgtgcccgactgagacctgatgtcttaaaaaaaaaaaaaaaaagttacaggtggtgagtgcctgtagtcccagtacctcaggaggctgaggcgggaggattgcttgagcccaagagtttgaggctgcagtgagccatgaatacaccactgcattctaacctgagtgacagcaagactctgagaaataaaattttaaaaaattgtcagggaagagcacaagagtcaaacaggaaaccacgacaatgatatgaataactgtccaaatgactaacacgtgaaaatgctcaaattccttagtagtaagggaatcataaatcagtgagctttatagactggcaagattttaaaaagagctgtatggcttgttgttggggaggtggagggaagaaatacttgcatattgctggtaaatgtatgaagtcttaaagtttcttttggaagtcaatctggcaacatctgggaaaattaaaaacaggcatatcctttgacttagatatgtcaggacaactgtacagtgtaataactgaacactagaaatgatgaatgtcacacaaaaggaaacggtaaacatgttatagcagtcaatgtcaagaaataccgtgcagccatgtgaagagtgaggtgagagttacagctgttggcctgaaaagatgtccacaagatacggcaagtgagaaagaaagatgcaaaagtgtgcgtaatatcttcctaaaaatcagtaaccaggctgggtgcaatggctcacacctgtaatcccagtactttgggaggctgaggtaggcagatcacttgaggtcaggagttcaaggccagcccagccaacatggtgaaaccccatccctactaaaaatacaaaaaattagctgggcatggtggcacgtgcctgtaatcccagctacttgggaggatgaggcaggaaaatcacttgaacccgggaggtggaggttgcagtgagccgcgattgtgccactgcactccagcctgggcaacagagtaagactgtggaaaaaaaaaattcagtaaccagaaaacgcacatagatgtatctgtgtaagtgtgtatgtgcttgtgcatgtcgggatgggattaagagcacagagaacaacgtggaaggatgttctagataatgacctcggtcatccaaggtgggagatgatggaactgggtggtaatgagggtaaagggagagagggagccatggatagatgggaacacgattatgccaatgcatgcatctgatcacacttactcaccaaaaatacataaatccatgagttgttatctgtggcagaatttatactgtttttcccccttttctgttctgtaacagaacctggttctcttgagaaggcagcagtgtgtttacctacgagattacgtttcccagcatctcttgcagctaggcatggccatgtggctagttctgaccaatgagatgaaagcaggaagtggttaaagcctcctcccttaaaagggagacaggttaccgctgggccctttcattcctttagatgtcttcctgcttccctggagtgcacacatgatggctggtgcttgagcagccatcttcaactttgaggggaccttaagaatggaaaccattgacaaacaatggcagaatctgggttcctctcaaccatagagccatcccaccagcctggactgcctacctggagacttcttttatgtgggagagaaattaactttttaaagcctctgttaggtttggtctgtgttataagcagccatagttcctgtttaaaacagtatgtactaaaaaacccaagaagtcaaaagaatacacattcaatcacaaagtgctaagctgcagatggagtattaaaagtgggaattaagagaccacagtaaatgaggtatcctagaccgcatgtggtcgtgtatatttgcttccaggctatttattcagaattgcctaagctcaaagtaacttaaccaaaacctactttctactctgaaaagttcaggcttgcttccatttagaagcacaggcagtatctcaataatcggaattcaggtaacaaagcatttattaagcatcttctctctccaccataaagtaaccactctaaggaagacagaagatgtacatgacccagttcctgatgccacgttaagactcactgagaaactagggcacagtagcaaatgctgtaatgaaatactggggcgaggaagtactacggcctttaggcaggttcttgattattctctggattcacttttgtatttggaagatcttagtacattcatttgaaaaggctttttaagcaagagaaagatgccattataacctcagagaagtgcagtcgtgtgtcacttgacagggatacgttctgagaactgtgccattaggcgattttgttgtgtgaacgtcatggagtacacttagacaaacctagatggtacagcgtatgacacacctaggctatctggtggagcctattcctctactaagaacctctgcagcatgtgactaccgaatactggaggcaattttgtttgtttgtttgtttgtttttgagagggagtctcgcactttcgcccaggctggagtgcagtggtgcaatcttggctcactgcaagatctgcctcctgggttcacgccgttctcctgcctcagcctcctgagtaactgagactacaggtgcccaccaccatgcaaggctaattttttatatttttagtagagacggggcttcaccatgttagccaggatgatcttgatctcctgacctcatgatccacccgccttggcctcccaaagtgctgggattacaggtgtgagccaccgtgcccggcctactgtaggcaattgtaacacattggtaagtatctaaacatggaaaagtacaagaaaaatatagtatcatcttatggaaccactgtcctctaggtggtctgttgaccagaatgtcatgatgtggcacatggcagtagtataatgcggaaatctgactggcaaagactttaggggagtctctcaggttagactgtgtttctgaagatctgtaattagaaaggggcatagaatcacttacataatattttctgcttaaattgtattttataatgagatccttatacgtgggctttagtaaacccgttcaagactaggggatgttttttcccctcgtaaattgagaaatgtcactgagaacagcactgccatctagcccgtttctctcagaactgcaggttttgcctctgcagcttttgactttgtaggcaaaaggtgaagtttctcctgcagcttttgactttgtaggcaaaaggtgaagtttctctaaatactagctcgcaaactatcaatagaagcaaatacctgagaactgaagaaaacccccaacaattggaaacatcgatgagaaataatggcaagttaagaaagcatagcttcttccaactttgtgaggcatatttagaaagaatttggaaaaggtggaagggtgggatgggggtgagggatgagaaattacctattgggtagaatgtatacttttattagagtgacagttacattaaaagtccagactttactaggcaacatatccatgtaacaagactgcatctgtaccccctaaatctatcaaacaaaagtttaaaaagacactgggcatggtggttcatgcctgtaatcccagcactttgggaggccaaggcaggaggatggcttgagcctgggagtttgagaccagtctgggcaatacagtgagacccccatctgcagaaaaataaaatcgccaggtgtggtggtgtgtgcctgtagtcccagctacttgggaggctgaggtgggaggattgcttgagcccaggagtttgaggctgcagtgagctatgatcgtgccactgcactccaacctgggtgacagagtgagaccttgtctcaaaaaaatgaaaaagagaaagtatgcttacatttgcccatcctagctacacatgtaagcctgagtaatatgaaccaatggagaaataaacaagttctaataacattctcagagtttgcttacaagaaaaagagtttggagaactgttagattaagagttttgttgttactgctcatttaggttcattgtaacaacttttgatttgggatggtataagactaaaggatagtttagggtaagaaatagaacttcagcattgatagtctgtgttccctcctccttttttcacatagctgtagattagagattcttgtttcccctttaaaattgtttgaggcataatttgcagagaaatgtacagatctgaattatagtgcagatatagcattgatgaattgatacacccatgtgaccacaccgctgctaggataacagtatttccatcaccacaggaagttcccatagatacaaccgcccttctgattactttcactatagatttgttttgttttgagacagtgtcttgttctgttacccagactggagtgcagtggcgtgatctcggctcactgcagcctccgcctcccaggttcaagcaattctccagcttcagcctcccaagtagctggggctacaggctcatgccaccatgcctggctaatttttgtatttttagtagagacaaggtttcaccatgttggtcaggctggtctcaaactcctgaccccaagtgatctgcctgccttggcccccaaaaatgctgggattacaggcgtgagccaccgtgaccagcctatagattagttttgattgttgtaaaagttcatgtaaatggaatcctacagtatgtaatgttttgtatcaggctgcttttgctcaatataatgtttgtttgaggtttatttatgttatagcagcacaaaacagaccaagatacacgtttaagtcaataatttgttcttttgttttctattgtataaatataccagtttcttggctgggcatggtggcttatgcctgtcatcccagcactttgggaagctaaggtgagtgggtcacctgagggcaggagttcgagaccagcctggccaacatggtgaaacctcgtctctcctaaaaatacaaaaattagccagacgtggtggtgatcggcccctgtaatcacagctactccggaggctgaggtaggagaactgcttgaacccaggaggcagaggttgcaatgagctgagattgtgccactgcactgcagcctgggcgacagagcaagactccatctcaaaccacgcacacacacacacacacacacacacacacacacacacacacactttattctttgttcgtctactgatgggcattggattgttttcactttttacctattatgaataaaatttctgtgaacaagtctgtagatagatttttgtttctcttgggtaaataccgaggagttgtgggattactgggtcattgagcaggtggtcgtttaatcttgtaagaaactaccaaattttctaaagcggttgtaatacttacattccgtgctagttggagcttttctctctcagccctcaatccatccttctttcgtctggcgtcctggagctagactgtaaacatttcttctttcccagctgatgcaatgttaggcgttgccggcagagggcactggagggacactgcaggaggagcggaactactcttcctgtttctggtgctgcttgccagcaggtggcctcccagcacctctcagcaataagcagtttcctgcctccaggcccagcctttgcacctctggccattccgtggcctcagccactctctctccgaagaggtctgagtctcattctgggtgtgggagcagggctgttccaagtttcttcctcccatgggtgttgtccttgatcctagaggctgctgcacatcttctcttcctatgttctttagacatgtttctgcccttctcagtagttaattccctttaactgaacatttatttttatttttttagcgacagggtcttgctctgtcgcccaggctggagtccagtggtgtgattcacttcctgggttcaagcgatcctcctgcctcagccccctgagtagctgggaccacaggtgtgcaccaccacacccagctagtttttaatttttgtagagaaaaattttctctgccttggcctcctggtgctaagtttacaggcatgagccaccacacctggtcccctaattttttgtgttaaaatttgcccatatcttcctttgtgaagtatctgcttaaatcttgtgccccgtttggggggagttgtttgtatttttattgagttgtaggagttcttttgtgagaatgcaaatcctttgtctggtatatgtcttgtgaacattttcttctagtctatccttgcctgctcactttttttattgtggtagaaaacataaaaatgtaccatcttaactatttttaagtgcaccgttcagtcgtgcaccgttaagtatattcacattgttgtgaaagggatcctggaactttttcatcttgcacatctgaaactctgcacctatgaagcaacttctcagtccctcctcttctcagccctggcaaccatcattccacttctgtttctatatgtttggctcctcatagagtcagtctgttttgtgctgctgtaacagaatacctgagactgggtaatttataaacgacagatttatttctcacagttctggaggctgggaagtccaagatcaaggagctggcatctggcgtctggtgaggatctgggcttctgcttgcaagatggcaccttgaagtctgtgttctcatgtggcagacgggtaaaaaagaccaaactccctcagttaggtcgttttatagtggcattaactcattcacgagggcacaccctcatgacctaaacatctcctaaaaggccccacttccaaacacagttgcattggggattaagtttccaacaagtgagttttgggggatacattcagacctcagcatctagtaccccatataagtgggatcctattgatagaaggtctctgatttacgaagtttgaactaaatgattttttgacttatgatgggtttattagaacataatcccattgcaaacatctgtatttgtctttctgtgattggcttatttcacttagcataccctatgttgtagcctgtggcaggatttccttccttttctttttttttttttttcctgagacagagtcttgctctgtcgcccaggctggagtgcagtggtgcgatcgctgctcactgcaagctctgcctcccgggttcacgacattctcctgcctcagcctcctgagtagctaggactacaggcgtccgtcaccacgcccggctaatttttttgtatttttagtagagatggggtttcactttgttagccaggatggtctcgatctcctgacctcgtgatccgcctgcctcggcctcccaaagtgctggtattacaggcgtgagccaccacgcctggccgatttccttccttttctatggagataccactttgcttatccactcatctgtggatgcacacaggttgcttccacctcttggcttttgtgagcagtactgttatgaacgtgggtgtgaaaacatctttttgagaccttcctttccaatctttggtctctgttctcaaatggaattgctggacgctatggtagttctaattttaatttattgagaagcctctactgtttcccatagtggctgtatcattttataaccccaccagcagtgcaccagaattccaatgtctccacatccttgcaaacacttattttctgttttttttttttttttgatagtagccatcccaaagggtgagtggggacaccacgtggctttgctttgcatgtccctgataattagtgatgttgagcatttctcgtatgcttcttggccaagtgtatatcatctttggagaaatgtctgttcaagtcctttgcccttatttatttatgagacgggctcggtctattaccaggctggagtgcagtggtgcgatcatagctcatagagtgacccttcagtgctttcccacactcccctggggtccaaccttctgccgaagatgccccagctctctgcagttccctgcccaggccccaagactcctttccctgtcggaaagtttcttaggcttcctctctctggggtccccacacacctctgttcccctccagcacactggcccaggccgggccagcctgcttcaacacagtgtcaggaactcctgtggtgtccacaagcccagtgccagcgcttgcctgccgtgggacgcactgtgtgcctcaggcccctcactcgccaaataggacagttatcctctgcctcggtgtggtcacaggggtgaaatgtgcctggatttgcagggtggctgcaacagcgcctggcccataggcagtaccatgaagactcacagtgtagggcaacagacgacgcctgagcggctgaagaaggtgggctcccagggcctccctgcccaggcctgctgccacggccagaacccaggggggcaccgtgtacctcgccagtggcctcagcactgcgccttgcctccaggagtcttggcttgtttgtgtggagctggggactgggagagcagagcttgtgacctgaggccccccagcctcagggtggaggtgaccaccctggaccaaggcctgccccagttagtggctgaggacagacaggagtacgtgtggcattcctgcggccccttgctcggcacccaggcacttcctcctgcccctctgcctctggaaggccagccatggcatggccacgggggcctgccacctggcacctccccaacacaatacataaatgagtgggtgtggctgttccaagaaaactgtgtttacacacacaggtgcgccaggcctggccgtcgagccctggtttgccggcctttgttcgagaccagtggttcccaaatgtgcacctgtatcagcatcacccagagcggggtcagagtctggactcctgggccccacgcggagttgttgtcaggggcctgggctttgcatttccacaggttccaggtgctgctgctggagcggaggccacgctctgagcaccctgctctagaagaagagatgcagaaaagacaggcagggctgcagaaaaggtaggcagggctgtagggtggtccggaccaccgggcactgtcaaatggcagatgtccctccgctctgctctgggtggggctggggccggagtggattttataaacactctgggagggtcccacccagaactctcctgcgctgtgtggaaggagggccactggggagggtgtagatgggaagtgagagagaagaggggacgaggagacccctgggtggccaaggaaacacttttctgaacaatcaaaaataaaggaggggcaggcagaacgtggggacttggctggggctgcctaggttccctggactcacctcctggcactacactgcctggggagccagggggccaggagccagggagcgactggcacaccccacaccttcctaacccagcccctggtggggagcccttccttcagcagcaggcagcacagcgatggccaagtgtccctccagggggacagacgtttgcccctccacgccactcacccggggtgaggccgcagcaccctccaccttgctccaccgtggccagcttctggcctcccctcaccaagccccgggacttcacgtgaagatcacttactggccttctcccctcgcggtcctgggttctctcctcctcctggcctctgaggccagaatgctgaggctcagactagggcctttgtctctgctgacacctcgctgctgtcacgactttgtggtccctgtgccactgactgcaggacgcgcagctgagtctccttggacctgcccaggtggcccccaagcaggatgtgtccaacacaccttgcttccctctgcctggccccaggccccactctggcccctgctttctcagtaaggacatccccactccgtggctgctctggccaaagacaggagagtcaccctttctcttcggcgcgtacccctcaagctccagcttgtgctcccagcactcccaccttgcacttccccatccccagctcctccccaccctgcccaaagccctcctgaacccattcttgtctcagtctccgcacatagcagccagagattaaaacaaaccagcccaaccctcggtggggctggtgttcacctttggggttaaattgaaagtccttgcgtggcaccacagtcactcagcgggcatcccctccctctgagtgctctcgccccactgacctgggcactgtggggccatgctcactcctgcctcgggcctcagcacctgtcccttcctggcagcctgtcccgcctggcatgctggctttgctccaatgccaacccttcggagaggccttccctggccaccctgttgtaaacagcactgcctgtctccgtgttccctgagtgttcctccaggcactgtcactgccagacgctggtatttttgtctactatggcccccaccctggctggtacactcagaaggacgggctgcgtcccctgtgcctagagaggcatctggcacagagccagccttcaacatatattgcatgaaagattccgtccaaggacgctgtagatgtaggtggacgcagacaaaagcaaagcaggacagtggattcgtccaaagaccggcagtgtcttcaggtgaagctgcagcgtcgagtcctggtgcttgcaaggtttcagcagcagaaacctgatggggctccttgcacctgggagaaaagccactccagtgaggattattgccagtgaaggctgccctggccccagacaagttttcctagaatttatggtagcaggcgggttgttaaaggatgattcccgaaagggccagacatggtgctcacagggatgcagggtgagcatgcgtcgaagagcttccctagcccaggcagctgtgaggaccagctcagaagagaagtcctgaaacagacacttacagatgaggaatattgacatgattgtgcaaatggacctgaaactggattttcagggggctgtgatgggctggattgtctcccttagattctaatgttcaagtcccccacaccccagtgtcttagaatgcaactgtatttggaggtagactttaaagagatggttgaattaaaatgaggccccaaattcaatctgactggtatgtctataaaaagagaaagtctggacatctggagatacatcagggatgcgtgactgctcagaggaaagaccctgtgaggcacagcaagaaggcaccatctgcttgcccaggagacaccaacctgtgacaccctgaccttagacttccacccccaagaactgtgagaggtagacctccttgcactgtaaatcactcgttctgttactgcagtcccagaaaactaacacagacctttgctgggcagaatgcctttgcttctctgcagacaagattacttttgcactattgcactgttgttatcaaaataattatatggggctgggcatggcggctcacacctgtaatcccaacacttagggaggctgaggtgggtggagtacctgaggtcaggagttcaagaccagcctggccaacatggtgaaaccccgtctctactaaaaatacaaaaaaaaaaaaagaaaaaaaaattagcctggtgtggtgtgcacctgcaatcccagctattcggggagggggctgagacaagacaattgcttgaacctgggaggcacaggttgcagtgagccaagatcttgctactgccctccaggcaacagaataataataatttttattatggaatcagtgtcaaatgctggtgccttctgggggcaacacacagtttcccaccaaagtgcatcagtgccccaggcagtcaaggtgccaggagacgaggaggccgcggatcttctgtccacctgggagcaagcctgcagcttgggaccctcctgggaccctgcacccgccagtgccctgccctcctgggctctcatgggagtgaaggagggtgggctctgtaggagttaaagaaagaggaaagaaacatgaaaagcggctcaacaaaggcaggtttattttggagaataaacctgaaagggacttctggccgattttggtcaggagccatctctcctacagactaaggatctttaagggtttaggaagtggggagcttatcgcaggctcggaatgtttctatgtgagggaaagtttattgcgggcttggaatgtctctggtcggaggggaggttatctcgaggttggcatgtttctgattggagatgttatttgtggtttacggtcgtgctgacattagctattgggctgatgtgttttgggctggatttaggcagctttttaatcaaagggaacctaaaatggcggtgtttgtccaagaaggccatactcctgctctgtcccgctccagcccttgggggcccctcgggctcttctcttggatggtgtgtgaatgggcacatgtggaggggctggtccagctctgcctgcctctggccatccaaaggagggacagcagggcctgggcagcaatgccggccttggagccccggggctgtggaggctgcttgacaggacacggagccccctctgtgctcaggtcgtggagggcctcgggcactacggtctgccaggcaccacatgtcacagctactcaaacacccagggccgccacggagggccaatggccgcaggatggctcaggacccgccccacccctgtcgctgcctttctggctgccccctagtccctggacaggcgctccccagccccaagcaggccccagccaatctcctgcccaggcaggagctccccctgccgccctcacagacctcacctcttcctacacgtttccaaggccgcgccccgccccgcaccccgccaggccccgccccgcaccccgccaggccccgccccgcaccccgccaggccccgccccgcaccccgccaggccccgcccccaccccgccaggccccgcctctctctccgaccctggacagtccccgggacccaccccgcccccaggtcctgcccccgcccgcctccgcggggcctcccaccctcccgggcagactccactcccgccccctccccgtgggtgcccccgccggccccgccctcccaggctgcccccggcgccccgggcctcctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcggtgagtccgagaccctgggcggggtaggcctctggacctggccgcgaccgggagcctcggaccctcctgcacccacgggggtcgttggggagtcaaatccgcgcctggatggggggtgcgggctgaggtcgctctcctccggttccggccaccggcgtccccacgcatggagccccgacctggacagaggagattgcggtgggttctcgccgtcgcggtgctcccgggagcgccctgcgaccctggggccaggccccctgtgctgccgctgcgcccctgagggccagcgtcctgaagtcctggaatatggggcgggagggccccagggcattggcctgccgctcctgctctggacacagaaggcttaggaggctgccctggagaaggcttaggaggctgcgaggacccctcaactgcgacacccaggagggtgtccccgtcccctggggtcctggtcaggcagcagtggttggcacgatactggggctacctggcatctgcggggacgcacgtgttcacacccgaggtggcctcagagccctgcttcctctgcccctgtgtggacctggttgaccagagaccagcgattgcgtctggactgagttctgcctgggtggggtcagggcctgggacaggcaccgagctctgtggtactccagcacagtgctgccagcctgggctgggcacaggaaggatggtagcttggggagcctgaggccaccgggatggggagaggacggttgcactggagcctccagaatgcctgggtgttccccaggagggcaggacactgcctggggcccccagatgggctctgctgtgatgtggggcctcccttggggccaggacagccccctcgccccgtcttgaacctgtttgcgaccctccatgggccactgcctgcctttccctcaggagccctttccactcctcctcctcccactccctgctgccctggcccctccccacactcctgcttgtgtccagcgcagctctctctcctgggacggctgggaccctctccggctctgccagagcccagggcctcccctggcatgaccagaacattctcttgtcccttgcccatctgccaaccacttccccgcccctcctatccccaccccctctcacggcctgttccctggcagctgcccctcctggccacccctttctgctgaagtggctgctcagaagccaccagcactctgtcggtgctctcagattccacccaccacactgtggccggtgcagacccctctggaggcccactctgcgcccagcccaggagacaaagcctagtggggctcgtccacgagggactcaggtccccaagaacgtggctgtccaggctgccgggagcctcctctgcacttctccttctgcctgtgaatggaacaaagtcattcacagcttggcaaacgcccctgtgtgacactccactgacacagagtgacacaattcctgtgcttggccctcacaagctagagagagaggctgccattgaagggatggcatgcattaaggagctagtcccaggggcaggatctgccagggccctgtaggggctgtgggctgataacagggtctgagctgggtgtgtggatggtgtggagtttggaggcagcccagggagggcttctctgaggacacaaggcctgcaggacaaagatgggagagggccaggccaggagcagccctgcaaggtgcaggaaagaggagtggggagcccagcagggccggagcctgccagagctgcccccgagtggggacaggacctggggactctgtgtggggcctcgtccgacgcccctgacgctaccccttcaggcttggagtgtggccaactgcagtttcgttgagctcaacatgtagttcttgagtggtccgagctgcaggggcaggtggactctgtaaccccaccacacacccgtctcgcttggcccccgcgtgctcgccgcagcagcctgtgggtgcactcacacgcgtgcaccgcatttctgaaagaggctgtgaggtcctgtgtctgggtgggaaacaagagacttggaggctggaaattgggtgtggggcgtcagtcttcagacctgaagcagccttctgagatcccttggtgctctgtgcactggggtcctggcttctgctcagcagcccgtcctcgtgtggctgcgaggtcacccccagctgttgctagctgacccatgtggggcatccacttccaggaacctgcaggaatgggctcccccaacccctcgtgaggttggagcagccagactgtcaggcgtcaatgatttactccctccacactgctgacgtgggctctggccttccctggggaggtgagaggggagtggtggctttgccctagtaaagctgtttgattgtcgctgttggaacggcttctgcgcctgctggtaaacagtgacctgtgggtggaacgctgcacacctggagccctgccagagttcagggagggcagaggtgatgccagtggggacgccccttgacccatcccttctctgagttcattgaagctatcacaggtcaaggggcatagcgaatccaaacacggctgataaccccaagcccaagctggcatcagtggccacgttctgtacacccgagaaacttgaagacttcctatgtcaaactgggaaccccacctgcttgccggcctgtcccaaagtccctcctgagcccggctccttgcaggcacagcagggagggcagagatctggggccaggcagctgagagaagctccctgcccggtgaccacacgggtcccagcagtcgagagtgtcagtggagtgatgcccatggcttcttggttactgcagtggcgtctgtgcccttggcctggacctccttcctgaatgggtgctacacgttcacaagtttctaagcctaagcttgacttcgctggtgacagtggggcccattgtcttagagagcaaagcctcctttccaggtgtttggcagggggctgaggagtttccaagtcaccagcaaactcaggcacctgcctggatgggccaaggaagaggttccaggcagggctggagggttcagattctgcagcccttgaagcttttggagggccctcattgagaaaagtaatacaagttacaaaatcatagttaggtgtgaaagccggtgtttgtttattttttatttatttttatttttttgagatggagtctcactctgtcgcccagactggagtgcagtggcgcgatctcagctcactgcaagctctgcctcccgggttcacaccattctcctgcctcagcctcccgagtagctgggactacaggcgcccgccaccgtgcccggctgaaagctggtgtttatttaaaataacaaaagaaattgccccagctgactgggcgcggtggctcacacctgtaatcccagcactttgggaggctgaggtgggtggatcacttgagatcgggagttcaagaccagccatggacaacatggtgaaaccctgtctctactaaaaatacaaaaaaaaaattagccagatgtggtggcagatgcctgtggtcccagctactggggaggctgaggcatgagaatcgcttgaacccaggaggtggaggttgcagtgagccgagatctcgccactgcactccagcctgagtgacagagtgagaccctgtctcaaacaaacaaaaaaaactgatgccactacatacctgttagaatggctgctgacgtacaacacattgactgcggggtgagtgctggagccccagagttggaaagtggtccactcgcaggttggtaagaaaactttactggcgacagtataggtttgaaaaaggaacgtttggccagacatggtggctcaggcctgtaattccaacactttgggaggccaaggcgggtggttcacttgccttgctaacatggcgaaaccccgtctctactaaaaataaaaaattagctaggtgtggtggtgcatgcctgtaatcccggctactcgggaggctaaggcaggagaattgcttgagccgggtgggtggaggttgcagtgagtcgagatggcatcactgtactccagcctgggcaacagagtgagactctgcctcaaaaaaaaaaaaaaaaaaaaaaaaaaaggaagaaaggagaagaaaaagaaaaaagaaagaaattggccaggctggttttgaactcctgggctcaaatgatcttcctgcatcagcctcccaaaattctgggattacaggtgtgagccataaaaaccactgcaaaagcacatatggagtgttttgcttgagagaagaggacaccaagagagtttagtcttgtctttggctgatttcgcctgtggtgcccacacatgcccccagcagggacagcagggcccatatccacgcctaccactctgcagcattcctggaagtttctggaagctgttcccccacatgagtcagcagcagctggaggtgaccttgcacaacgtgagcatgtcccacaaaaccaaaccagatatgccccctccacctttcccataaggcaccccagcttcacccgccgtgatgagtggagagtgactttttgtttcctgtggccactgtgccgggcggctgaacatcacagaagttcgttctgggttctggaggccgaggcctgagaggggtttccccgggctgagccaaggtgctgcagggcaccgctccgtcctgacgctctgcgggaggagccacccctgccacctccagtgtctggtggctgctgcaatccttggcttgtggccgcatcactccagtcatccaggccagcatctccaagggccgctctgccctgtcgtcatatggccttcccctccccgtgccctgtggccttccacctgtgaggaaacacgagagggcgtttagggcccacctggattgtccagggccacctcccgccccatgacccctaatatcacatccgtaaagacacttccatatgaagtgacacccacaggtaccggggattgggatgtggacatctttttaatttttatgtatttatttaattttttgagacagtctcattctgtcacccaggctggagtgcagtggtgcgatcttggctcactgcaacctccgcctgccagattcaagtgattctcccgcctcaacctcccaagtagctgggattacaggcacctgccatcatgaccagttaatttttgtattattcgtaaagacagggtttcaccatgttgaccaggctggtcttgaattccagacctcaagcaatctgacacctcggccacccaaagtgctgggattccaggcctgaggcactgcgcccggccctgggatgcggacatctaggatgctttttcaacccaccatacatgagacagggacacttggacaccggtgtggggtggaccctgagccccctggatgcccagggtctgaggttgggtccttggggttcacaaggctggtgaatccagacctttgttccggcagcccgtgtcctggctgtgctctgggcgcctcggagggcagacgggcagacaaacatgtgcgggctccgcctcccccgtctgctggctgagccctactggcggggtgattttgtcagcggctgcacctcagccggcctgcatcttccagtcctctggcaaacgtccccggggctccacaggcctttgtgtaaggccagaggaggatcacgggtgccataaaccttcacggggccaagggctggtgtcccggggctggtgacttaacaggcagagatgtggagaccagggtgagcccagcagtggagggcgatgtcagggaggggtgcggctggagggatattagagggggctgctttaacttgccaagtttggggttaatttgtgagccagtgataggcgatgggtacagctgcagagggcgaggggggaaagcaggtgaccatggctgggatctgcaggataggatggggcattgctgctgggggagggaagggagggccgggagggagctttgggacttgctggaggccctggaggggtggctgaggggtcagggctttatactgagcagctggccccagggaatgagtggtgtggccaggtctccatttaagggacagaactgagatgcagaggctgcaggaaggtggcagagttgctgggggtgggaccagcccgtctgtgcacttgctgtgtgctaggccctccaggtcggggagctggggaaggggacctgggctggaccctgagggagtcacacagtccgtgccctttgggagctcgagggccagtgagggagaatgtgggaatagcactacagcctgggcatctgggagggcttcctgggggtggtgtcccaatctgggccttgaggcacctactgggtgagaagtggggacgaggcaggacttccaggcagagcccacagtatatccacagtgaggcaaaggctgagccccgtgggccttggtggggagtgtggactaagcatttggagaaggaggtgggagcaggggcagggcctgggtggagcagctagagacctgggcagagctcctggggccgtccaggtgcgaaatgaggaatcaccacgggctccaaggcaggaagccatggcttccaaacgcgggtcagccgcctgccctctgaggggtcccaggggcagccatagcccttcctcccagcctctgactgtcataagaccggagccccatcccaccagctctggtcctgcccctcagtgagggaggaggcggccatggctgtcagcccctgaccccagcatccacctggactctgcctgcagtgcttgtgcccgggacgggcctggctgccatcctgaggacactgcccatgttccatgacgaggagcacgcccgagcccgcggcctctctgaggacaccctggtgctaccgtgagtgtgggctcctcccagtcccggacagggcatggctgctgaggggcaccgatcctgaggctgggcactgctggccaggcccacgtgagccatttgctcacccctgtctctaacatcccctcagcttacagggctttaggactgaccagcagtcgccttccaccagagcctgaacctctgagggtgccccgtgcctggtcccaccttccctccccaccctcctcccacacccccagccaggctgcttcggcaagtgtgatgagggcgccccgtctagggatcctgtatatcaggagccagctggcccaggtggccttgcccccagcatagaggtccttccatttctcagctctgggcccagctccctgatgtcccccacagctgggggtgagctgggagttgccctcgtggtggctgaccaccacagccgccacaggcgagcctcctgcaagcatcctctcctgcctggggatggctggtcccagcccccctcttcgagctggtgtgggaagaagactgctgggagtggcccatcctgacctacgtccttgcctctgtggggagctccaggtggaaggggggccgggccccgtacctgggatgctgagaacttgctatgtgcggagcccttggcgtaggggccccagctctgccagaggggaacagagcgggtcagggcatttagagcaggaggaggtgcagagcgggagcctgctgttccgcctcctgctgtttctgtcccgcagcccggccagccgcaaccagaggattctctacaccgtgctggagtgccagcccctcttcgactccagtgacatgaccatcgctgagtgggtttgccttgcccagaccatcaaggtagtggggctggggaatgctgggtggggctgtggtgtgtgggtggggctgaggtgtgtgggtggggctgtggtgtgtgggtggggctgtggagagtgggcagggctgttgggtgtgagtggggctagggagcacgggtgggaatggggagtgtgggtggggcttggagtgtgggcggggctgtggagtgtgggtggggctgtggagagtgggtgaggctgtggagtgtgggtggggctgtgggtgtggggtgggctgtgttgtgtgggcagggctgtgttttgtgggtggggctgtgttgtgagtggggctgtagggtgtgggtggggctatgagtgtgggcggggctgtgggtatgggcggggctggtggatgggcagtggccggcagaaacactctgggacgggtgaggagctgcagggtctggggtggagtcggcctgcccagcctggggcctgggagcatctgggaatggcagcttcaggaaagggcagggtccacgtgtcagagctgcgggcaaggctctgagttcctctcccccatgcaagctgggggtgggcgtatagggccaagtcgacttcccagatgaggacacaacgggaacagttgtcttagcctgtcccagttagtatctggggcgcggtgtgtggtgtgtgatgctacctcgagggccagcaagctccttgtgcgtggctggtgacctgctcactgccctctgtccgtccccgcccagttggagtcttagtggatttagtggagtcttggttggagtcttagtggaccacagcacctctcaaagactcttgtggtttacagcgacctgtgtgctccccctgcaggcagaaccaccccccgccccatcagcttttcttctcccttctcccccatcacaacacgctcccatgttaccggagctgcctcccctagtagggggcctcctgcccgctccagtcccaattctcacctgcttcccttacgaaccccctgctcccctgagtgggaacatctaggcttccccttcccagcagcagggtggcaggcagcaccacccaggacaggaccctccatttgtagccggcagccctcaccgggcaaggcgtgactgctttttgaggcccacgaagctgccctgcggtccttgctgcagggagcagccctgggcagcctcacaaaggccttctcggctcaggtggcccagcctgccgtcttgccgcgagtggccagcagagggcgcccttcccctccttggcctccgctcctctgcagttcccaggcctacggggcttggtcttttaatggccccccgggcaggcccaggcttcgtatggagccctgggctctcggaacggtgccctggcagccgcagcctgggccagccaccctccagggggtggtggccggaggacgtccctgcatggccagcttcactgctgcccttcggtgtcctgcccggccgcccaggtccagatccaggcaacctccaggatcacctgctggttcccggccatggctgtgccttgaccctgcaggcgtccttgtgcccaccgttgtgttcttgcctgacccgcggtctgggcttcgaggctcgtgcaccaccacagccccctgctgccatggagaggcgctctcccgcccttggggagtgtgcagaggccccttggagggactcattctcgagtgctctgaggggagcctcagcgtggtgggtgcacccgagtggcatggaagcctcggggcagggagagcgtgggagtcccaggactccacgccaggggctaatcttccagagagggacttccaggccagggtcccacgggtgcctcccctgagtcctcctctctgcatccggaccctttcccccatgctgcaacctcccccacacctgcttgcgaggggctggcctgcctgagcatgcgcccctcctgcagaggcactacgagcagtaccacggctttgtggtcatccacggcaccgacaccatggcctttgctgcctcgatgctgtccttcatgctggagaacctgcagaagactgtcatcctcactggggcccaggtaatcccaggggcccggggctcctaggaacaggggcttcctgaggccacagggcaagtcagcgctgtgggcggccgctgcgggaccccgggcttcctgctcagcccagcagctcctgaggtggctgctgcagggcccgtgctggggctcgcaaatgctcaggtcctgcccgggtgccagcaccacctgccccgcaggaggggggtcatctcctgctggtggccctgggagctgtgaggccctggagcacccagagccaggcccacctcggccctgggggtgccaggcatcccttcctctcctcccgatgcttccttgcggctgctgcccacctctccatctggcgcatcagggtggccgcgcacagagccgcaccaggaggccccggccatgtccctgcctttgtccctctctttgctccgcccactgtgggtctaggcgatgccatcctgggggccctggcacacgatttccctgcctctctcaccctaacccagcacaaatcccataagccaaggccagtagagtgttctggaaaactggatttgaggggatgtggcaggggaggttggctagaagctgactaggggtccatgttgcctgcgggtggcagtgggcacctgaaccccttgggatcctttcccacggctgaggctaaggtcttgtatgggaaaccggtacctgtgtccctttgagcttggtggcagttccagaaagctccatggaggccctcttaggaggtctgcggggagcagtccggggaggtggctcagccaccccactctgcttgcctggcgccgtctcccttgtccctccagagtctccccagggcccactgcacacacctgttagcggtggagcagtgcctcccgccccagaactcgagaaggagggacagggctccagctggttctcctcttcccagaccttcccgagccctgggggagcagaacatcccgtggacctctctaggggatcaagggcacagttatgagcaccgcaggacccacgaacgttcacatgcatgttgtcctcactctgatgttggcctgtgccgggacatccttatccctgttatacctgtggggaaactgaggcttacaggctaggggctcacccacagccacgtaccacgtgagggctgagccagggagcacccaggacccaggactgccaccccctgccagggctctctccctccagagcctctgactgaccacttcccggccgcctcctcctgaaaaccctggcctctgcaccgccacctgcgccctcctgggacgcgctgttcagtcaaccatagcacagtcgcccatgctagacacaggcagctgtgggaggagctgtactgtgcctggcatcccgaggcagttcctttctgtcacagcccacccacccctcacccccaccaccctccttccagcccatagttctgctggggtagcgagggagctgggcagggcagctgcggtgggaggcctgtgatgcgttctccagtatggggaccggctggcccctgctgccagcactgggctcttggacctgtagagggagctggtgggtgggttgaggccctgggtgcaggctggcatggtctgcagccacagctgttggtgggtgggttgaggccctgggtgcaggctggcatcgtctgcagggacagctgttgttggcggccttggagacaggcttactgcccagctcctctgagtgccccgttcccccaaggcacccatctccaggctgcctgctgcagtccaagcccgcctgtccttctctttcccacacccgcctggggctcctgggctgggcctgggggtttacctggagagatgagccagacatcccaggcttctgggcttcccaggcctcagctactccgtggcctctcccccaggtgcccatccatgccctgtggagcgacggccgtgagaacctgctgggggcactgctcatggctggccagtatgtgatcccagaggtacctgcctggtgcacgtggaggcggggcaggtggggtgggggcaggagcccagacagcagccaggaaacaaagtccccccagcccctccccagacgccactgccaatagctgggtgcactgtcttctagatcttatgttgtggatatttacattagaggtacgtatggaagttctacgttagagatacgtatggaggttctgcgttagagatgcatatggaggttctacgttagagatacgtatggaggttctgcgttagagatgcgtatggaggttctgcgttagagatgcgtatggaggttctgtgttagagatgcgtatggaggttctgcgttagagatgcgtatggaggttctgcgttagagatgcgtatggaggttctgcgttagagatgcgtatggaggttttgcgttagagatgcgtatggaggttttgcgttagagatgcgtatggaggttctgcgttagagatgcgtatggaggttctccgttagagatacgtatggaggttctgcgttagagatacgtatggaggttctgcgttagagatgcgtatggaggttttacgttagagatacgtatggaggttttacattagagataggtatggaagtttctataaaaacaggttgcagccagcagggctctgaagggtgtcactttccctcccccatgtctttccctgtttcctgtggcgtcccaggaaggagtgtgcaaagatctcccccaccctggggcagtggctttacccaaggctcttgagcagcttgactagagcccccacacgggctcctgagcaggggcctcagggactcccattcaccgtgggcaggggcctccagcagctgtgctcgctgcacctttgggatgagttcccagggctctgtaagaagcagggttgggggcagtgggcaggtgggaagggaaggaagtacggtaccctcctgccacccagccacttgcacgccccaggccctggggtccccaggcccctgcaggctccggttagcccacgggtaggtggcagggcaggaaagggcccgagaggggcagtacctgctcccaggaaggtctctgcctgcggtgggtggggttacagtcccacctccccctgggtctgggcacctcattgatggcagggaggaagctggagggcagatgggtcggggacagggtggccgctgctctgaactctgtcgctccgttcccgcaggtctgccttttcttccagaatcagctgtttcggggcaaccgggcaaccaaggtagacgctcggaggttcgcagctttctgctccccgaacctgctgcctctggccacagtgggtgctgacatcacaagtaagccccgcaggagcagggccaggtgcctgcccagtgctggtgctgggcgaggggctgctgcagggagctcgtggctgggactcggcagagtttgagagcaccatgcttggttctgacttgccctggcttggttctgccctgggctgtggagaagccagggctgcgtggacagggctgctgcgtggccacagaggtgggggcctcctcaggtccctgcaggctcagaggcgggaggcctggaagagaggtttggggcatctggccctcatgtgtcctgcccaaccactcgccccaggcctaggaggtccccagtgaccacctggctctgccacacctctgtgtgccgtagcctcgtccccaggagtttcagggagtctttctgtcctctggttccggcgggcagcccagccatccttgtggggctgactcgagcgatcctgtgtcctgaggcttccccctgggggggccaagcccgccccctggccctggctgtaggagcagccttggagcttgttctcagagactggtgccctgccaggcctcacctgagacgcagggccactccagtggcctgcccggaagtcactccctggcctaccgtcgctccgtctggggtgtgctcctgctgagggagcccctgcttcctggactctacccggcccctgcctgttccaggtccacggccagcatggccagtcctgaccccacgccagcacccctccctgaggcagcgggagcatcccctccctcctgggagatgcatcctgcctgccctggccccctgctgtttcaaggcagccccaaacctgccctgtgtctcatcctgactgactgaggtggggtccagccccggggaggctccagggcttggcagcactggccttcctttgggggcatttgacacctcacccggggctgggtggggctgcctgcccaggaccaaagcagctgttcctgtctgggcgggtggggtggaggcgccccctcacccacactgggcttctgtccaggcctgggccatggcgggctggtgggtcaagcccacaaggtcactggacgcctggggaggcccttcctagggaatctcccggtgcggcagaggctccccactcccccattttaaggaggagcagaccctcctggagaaagggttgggctatgggctgctggggcacagcttcctggaagaatccccagacacaggcaaggaccctggggagcttcagggcctggcatgagggggccctgggaagggtctggcagggcaggggccttcctggagcatctaccagaagtcgggggacaggaggggctctgggcatgtctggctgtggggccgtcagcagaagcgggtggaggcagcgtctttggatctcaagacaaggcctgtgtgtgggagtccgggctcggtggctgacttgcttgttgccccagggcccctcagcaggacaggacagaggaaactgcctggttctacaggtgagaaacggaggcagagagaggcaggctcccacagggaggcaccgactcaagcctgtgcgctgtctcctgtcctgggctcacaccccgtcccttcttcctgctgttccctcctgtcctgggctcacaccctgtcccttcttcctgctgctccctggagcaccttctagggagtgtgaggcccagaacacatcagtgtgtctactgtgtgtgcagcacaccgggtctcaggggcttgggcaggggcccacttgctcaccgagggccagggcagccctcaaggcttcttggaggaggtggcttgtgagctggtgctggtagggtactggcttgcttgcccatgctggatgctggcactcggcccctccagcccagggagaaggagcagcaagaggtgtgggtggtgccctgcaggcccggctcccccatggggcctgattcacaccttatctggggctcaggagtggagcttctgctggtgggtggaccccgccccaacagtgcacagaggaccgtgctctggattccagggactccgccagcaccgggtgctaagcccgggcaggccacgaggctcaagacacaccggcctcaggcccagggccgtggggcagctcctgggcgcagcactaaggctggtctgggtgggaggctgccctggccccagccccccacccctgagtgtttcccacgtgcgtgtgggtgtgggaaactgatgccgggctgccgggccggttctggcacccagtgttgagaaacctcaggccttgcccagggcgtggctgctggggcccctggggaggggcacaggttggcagtgtgcaccctcagcctctctgagccagctgggggtagcaatgccggcctgggcccgggtgccagctgccagcaccctgtcgagggcttgtcctgggctttttacccactgtctgggaagtgaggggctgggctggtccgggagtcatgggcgggcttggtgctcctgtccacagtcggctcggcgccaaggggtggggggatgcgtgggaggctggaggaggccctgctggccctgtcctttccatgtgtctcaggagaccacactgtcacccccaggcaaatcctgcacccttacccttctgtgctgagccctgaccccggcccactctgctggggcccttggagcagaggagggtggagaaggggatatggctgtggggtcaggccaggcctgtcactcaccagccatgggtccttacgctgggtcaccccaaagcagagccccagagccctcctctgtgcactgggagaagccacctccctcccagacgtgacccagccaccccagctgtgccgcatccagctttgaggccgcagactacacccttcggctcctgtgctgagctcccgtatctgtagaacagggccatagcccctcttgggggtaaggggctgagcctgcaggcctcacctggccatggagccaccagcgctcctctctgcccccgggtgtggggtcacgattcccctggcctctagcaggcctgggcaggaaggactgggatcccaagggtggcatccacagactctcaggaggcgggaggtcagtgcggggtgggtgtgggccctctttgtctctgtgtagccccctctcagccataactctttgccagtggcagcggtgccccctcctttcctgtgctgatgccttatctgcttgtccggctgagacacacgccctcagttaaagggcatctcacgctgccatcatgtggggctgactgatgctgtgggctctggtgggggtggaagactcactgctgggggctccgctcccccctctctcatccccagcaccccacatctccccccttcagctccaccatgccaggaaagtcctttttatcgcatgcaagctgctctagcggaagcggccggagacatgtgggtgacatctccctgtgggcaggaggaagagccctgtgcgggggtcctcctgcccaggttcctgtcccagcaccgtgccgggctctccaggcgcccaggcccttccccacccctgggcctcggttttcctgggctgggctctccagcctccagggtgtttactgccctgggcagctctgacacctcacagtgtggtgggagtccccagtgtccagccctgctctgctggaggctgccatgagtgtggagaggggcagagggaatggacctcagccttggcgctggcctctgagggtttgggggccgggcctgtggcatcagcctcccacccccacccacatggagcgggaaagtcggcagaaccctgggggctcaattgctgccagagtggcggccttcagctcgaggacaagcatgtcctctggggagcccctctgcatggacgggttcaaggggcactgaccccaaatagccatccctccccacttcacctggggcctgcacctccaccatcacccaccctgggtgtggggagggggtgatgggcacacattaggattttggggtgaactggatggaggccttctctccccagaggtgaggggtccgaaagtccatttgttcgctcattcaaccactgacccggtgggcagtgggcacagtgggtgcctggcaaggggcagaggaggctggctggttcgacgatgctgccccatgcctgtaacccagcgcagtgactgctggtggctccccagctgggcatgcctgccctcctcgcctctgcgctcgcctgacgcccccatgcggcctgcaagacacagccgggcctccatctctgcaggaccctcctgcccctcgcctggccagcggagtttccctgggcttcacccttgagactgtgttgcccattgctcggccatcggtctctcgctggccaacgagtgcctcctcccacagccccgtgcacgctgcggagcctggcacaggccggactgcgcggaagcccgggaggatttgcctgcgggagaggaggcagggcgagggggctgagccgcgaaggctcagggctctgaaaacaagggaggaggcggcctgtgcagagggccaggcactgggctggggtctcggctggcaggaggcctgaaggcaccacacaggcccttccctgtcctcagtcaacagggagctggtgcggaaggtggacgggaaggctgggctggtggtgcacagcagcatggagcaggacgtgggcctgctgcgcctctaccctgggatccctgccgccctggtagggaccgccccggccatcctgcccctgcagccctgagccccagccctctgcagctcccacggccctcaggctccctggggccctcaccagccagtgcagaccccgcgtggacctgagatgtctgcagtgtggccccaccagccccaggccctgtcccctgtcctccgtcgtggtgctttccagcctctcggggagtgggcagggttggggcgcggctcacagccagaacggggtcctccatgcttttctagaggcagcgtcctcccgcagattccagctggctgggagccgcccctgctgtgctggacaagggtgtttgctctggggcctctgatggccttcttggctcctctcccacctctctgaagtgtttccacggcgttctgccacacaaagccttcgtccctacagacagggcgaccctttgggagaatgtggggggagcagccccctccaggtgccagcagccatgcacgtctgccaggagccccactgtcccgggagcagagcaggcaccagctgcccctggcttggggtccctctccttgggagggcatggggcgagtctcagtggtgctgagggcagagaccctcaccatccagcccccaccccaccgccccacaggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggtagtgccgggagatcagggcctagcggggaaggggacagcctgagggcctggcagaggtgggctctgacccacccctcatgggctgggggccgtggtgagtcgcccttcctgcccacacgccccctcctcacaggccatggcgggagccggcgtcatctcaggcttcgacatgacatcggaggccgccctggccaagctatcgtatgtgctgggccagccagggctgagcctggatgtcaggaaggaggtgcgggcgctctcgggctgtgggcaaccctcggtgtgcacaagcatgtcagttggctcccaggggcatgtctggggcgatgccggaagagcctgggggccggtccagggtgtgtcctgtttgggaaggggagggatgtggctccctatagtggggaagggcagctctgggcccaggctccccacagccctcactggactcccagcccaggctccgcctgtccttgtgccttctcagactgcatggagacctgaggctcccctaactgtcgccaggaaatcctctcctgctctccactcttcctcgagggtggggttcagacacagctggccccagacccttgggttgccagcctctggggctggacggaggcttttggggcccctggagaccctgagctggtagggccagggagtggggctggccttgggaggggacccagcccgctctggcccgagggatgaagcacacacggccgaggctcaggccaagggcaacccctgactgtgcccgggtagcccgaccctccaggctgtcctgggctgcccatccagccctggcagagccacttcacctctgttctctccaccagctgctgaccaaggaccttcggggggagatgacgccaccctcggtggaagagcgccggccctcactgcagggcaacacgctgggcggtggggtctcctggctcctcagtctgagcggcagccaggtaatggcgtgggacacgggcctgagtggcagctggggactgtgcaccctcttggtcaccctgggatgcaccaggcaggcacgagcccctgtagccatcactcgagcccaaacagttaggcacacccgggttctggggcccaggaggagggtttggggtctgcagcaaggaaggtttgcagggtctataaggcaggaggcaggaagggccaggcggtgggcacacagcagggaggccttctgactggcggcgctgccttagtgcggggctgcctcgggagctgcctgtccagaagaagggcgggtgagtgggggcggtgcttgctctgggctctcccaggctctgagcaccaggggttccaggtgaggaacccggaggtgagggccagcctttgagcacgtcccctgcacaactgaggtgcccagacctaggaaggggggctttcgaggcctggggtctgcagggggatggggcctccctggaccccgcaacatgcccccttggctgctgggccaaacatccaggcctgacatggggcctggcaggccagacagccttgctccccactgtgtggggtcctgccccggcctcagtgcctcggtttccccctacagggatggacctgtcttgtgagccatgtgctggaactgccacttgctggggcgggtgatgggcagatggaaaggactggcgtgcatggcctgttattagggtggctgcatagggcctgaatgctgtagggaggcaggccagaggcagcagccttgtcaccaggccacgttgtacccgctgggtgtggtggcacctgtggggcctctgccaggaccgctgggtgtggtggcccctgtggggcctctgccaggaccgcggccttttggcgtcttggggagctcctggtgcccggtgctgggggcaggtggctcttctgggaaggtgcagccgtgggaacagggccttccttccaggggaggggtctggctctgcttcccacgctctccttatgtgggtgaccattccgtcccgacggcggtgggagcagacgggggagtctgggagggtgggtagcaggtactggccacacacccgttggggacagggctggatggtggtctcgtggcctggccttagctccaggggaaggggtcctaggtgggcctggatggggtggggtggtgaggctcaaccccaggccttccgatgtggcagctcaggttccttctcacccacgccctgggatctgcgggcccttgtgtgggggctggcaggggtcatacagcaccggggactgccagttccaccagatgccaaagggaggcgtgggtcccagggtgccgccttccccacctaggaggcagatgccctgcggaatgccctggtgcccagcctggcctgtgctgctgcccacgccggtgacgtggaggcgctgcaggcgcttgtggagctggtgagcctcccccaccctgggggcccagccccagccacgcctggcctgggggctctgaaccctgtaggcaggacggcctttcatccacccactgaccacactaagcccttgtcagccagactgggcagcaggactgtcctgccagcttgtcaggtctcactgaggctttgagggtgggcgcaggggctgtgctgggccctaccctcagagggaccccaccctccccatggcctacctggccccgcctgggtctccctcaggggtcgcatgtccttgtgttactccagggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggtaatggagctagggctgcacagagctgccttggacaggtgggcgcagagaggctgtgggctcctgcactcaaacagcctcccggggctgggctgggagaggtggaggacacctgcttcctaaaggctgcccccgcagcccggggcccagtaagaccccggcccagagttcctagaaaacaaaaatgttgtggacaaagctgggaggacacggtgcatctctgtgcacctgtgggtatggggggctggggtggaggtggggcagaaggtcctggcccagcagccagacgcggtcaataaaaagcaggctacgtggcagcagatctggggctgtgacaggcaactcgggccctggaggacaggcccagcctgtgcgtgtgggggtcccctgccccaccaagcaagccctggctggtgtctcttcccaaagtccagagcagcagcagagacggagtgtgtgcctgtgcccctgcgtggggggcggggccagcactggtgggatctgcgtcccgtctccccttcctactctttattgccccagcctgggaaggccaacgacctgtctgctggtgccgctgcccggacccatgggctgctcagagatcccagggcccctggggattcctccctgtgggtgggaggacttggcctgcaggaccctgggttcttttcggggagggagtgctcaggagtcccatggagagaaggccggggtgtctgagcctggggtcatgtgaccctgacgtgttcagttgtgggttcccctccccagcggtgaagcggtgagccctggggtggggtgtggcaccttttgtgaagtgggtgactggggtagaaggttctttccagcctcctgtgatcattgacagggtgctcaaaagaataggagagaacagggtggtggacaggagggggcggggctgtgagggtccccccgagcagggctggggtgatccggactggagcttctagactgggcgtccttgggtgtgggtgggtggcgcggagacgagctcacacagtcccgccccctcgtctcctcctgactcacaggaccaggctcacagcacgcccccaaccggtctcccagcctcgctccgctgccaggctccctgaggccgcctgcctggccctgctgtgcctgagtggggtatggggaggccactgcctcatacctattcccaggctccctaaatggggtgatggggggatctgtggtgctttgcaggggtgggggcacggccagcgattatggcacagtctttaggtcaccctgtacaatgggctgtgtggcctccggcctcgggcctttgtgcctctgctcctccttgctagagccccgaccccacccccacagactccactgtccgggtgccctgcccccactcctacccaagggcagtcggccggattgattcagtgtcccctgcgcctggctgaggaggtcaccacggggtgtgatcagcgtttgggtgtgcagtggggccggtcagctcatgtaaggctgtcctctgaaatgggctgtccccttggaatgggttggggagactgccctgggaggagctattctgctagcaccaactaatgccctcccctgggtgctgggtgcggggctgccacagagttgaccccaccccttgcagacctcagctgccctaagaaggagtactggacaaatggaggtggtgggatcccgggatgatgtcacatgggcctaggcagaggatggggggatgggcccttgtctgaggctagggctgtggggtcttgggccggccggtccccgtccctgtgcacaggacatgagctctgctggctcctgagtgaggtgcagcggggctgggctggccagggcagaaggtcagcatgctcattctcacacaggcatccgggtgtcattgggttgctgcgggaagccggggcctccctgtccacccaggagctggaggaagcagggacggagctgtgcaggtgagtgcagctagagcacctgctcttccagggatgtgggggacacagcttggggaagcgaagccagacctgctgggagggacaagtgagtcagggtgtgggggctttcagaggcgaggcccgctgacctcagtgtgcaccaacctggctgatgggaagaggtgtctaccctggaccatgtcatggggcaggggaaggagttgttctcagctgagcgaacagtccagcaagggtgtctctgtgtgcacatgtgtgcatgtgtgtatgcatgtgtgtgggtgcatgtgtgtgtgtgtggtgggcttgaggaggggtatgggaattggttgtcgggtgtgagaggggctggggtgtggactggggggtggctggggctgcatttggggaggttggggcaggtggggcacagaggagctgaagcccctggcaggtgacaggtctcgtgagctctgttctccccagcgtggttcctgtcctgggataaactgacctaggccccgcctccacctgctggccgcatggcaccagtggccagtgtgccttccgatctcatgctgccgagtgaccaccgaggcaggctcaggccttctgacatcatgttgttgttggggagactgaggcgcagggaggccttcggcgagggtgtcggttgtgggtggaggtgggccagggatgcagggatcctcctctgtccgccacagccagaatcgctgccccccaccccatgccttgtgcctggtgacttggcgctgcctcctgtgcccagcctgggctgcccgaggccaggacgactccgagggacccaaaaaggagagtcggaggcaggagacctgggccgggtgcaggtggtggctggggtgggggtgctgtgagtggtggggtctgtgcgcctgtaagtccagagtcccaggcttggggagtgggtgatggcgggggctcggctcactggctgggagggggtgggtgcaggcgcctgcccagcaggaggaggactagcagctctggcttctcctctgggaccggcccacaacccctggtcttgcttttgaagggacttccggggtgacttggtcaagatttgcactccagacaggccttgctggctccattgacagatggggaaactgaggcagtagtcaggtcctgtgggagctgggaccagaaccctggtccaggactctgcttggaagtggcctggccagcctgagctgctggctggacttgagcccctcggctaggccttcctaggggccggtgtgtgtgtggggcttggcctcttggagcaggtccaggaggggccagtgaggccatccagcagattcgctgcagagattacccagtgccactgcagggctgctgctgtttcctgggtaggcgcagagtccctaagggccctccagaggagggggcagccccttcctcaccaggccacttcccccagcccctgcacaccatgggtgggtggagccttccctgccgggtccccacctggcctgctcctggcctccccaggtggcgagtgagttcttcccaggagggtggcagggtgaggaggagctggtgagggcctggcaggtgctccccactccagggcaggtgggcccagacccctgtcccagccaggacccccccatgcagtctgccggggtccagggccaaccgttatcctgggttgcctcctgtgtccccctctctgaaccactgggctgcctcaaactttccttccacctttgcggaccccgccccgggaagagcggtgtgttgtgtaacacgaaactggcgtgggctgctcggcaggtgggcgtgcatatgtgtgtgcaaaggcgcatgtgctcatgtgtgtgtgcacatatgctcgtgtgtgtgtgcatgtgtaggtgtgtgcttgtgtgctcctgtgtgtgtacatgtatgctgctgtgtatgctgctgtgtgtgcatgtgtgttcatgtatgtttgcgcatgtgtacccgacttgagtcgcagtcccacccactgggtgaaaccaggctccaggctgcccgatggcccccagtgactcctgccccaggaccaggtcgctgctgggtcagctgtttggggctggctttgtaagagcgtccaggccacctgggggacaggcacgtgggcagatggacaggtgcccagcaggccccaacaactcctcctctgcccccacccccaggctggcatacagggccgacctcgaaggcctgcaggtgtggtggcaggcaggggctgacctggggcagccgggctatgacgggcacagcgccctgcacgtcgtgagtgcccccaccccctgcaccctctccaaaggctgccacctccaggaaggacacctggacaattcaccagctcactgctctgcccctccccgctctgcccctcccccaaatgcctggccctccccatgcaggacccgcacagactgggtccccttcccggggctctgagtggtgggggtgacgagagtggaggagctgctggggccctgtgtgtgtgggctggggacaggggagggcatcctggggatggggatccttgggccaggctgctagtcagtggccccaaggcagcccctccccactgcttccccataggcagaggcagccgggaacctggcagtggtggcctttctacagagcctggagggtgcggttggtgcccaggccccatgcccagtaagtccccaccccaggcggggctgacaccccccagtgagcttctagtgcagggctggatcctggctcgggggggcgtaatcaaggggaacagaaccggaggaggctgagatgggtcccagccagtttagggtctgcagagcccctcctggggatgtccagggtggaacacagtttagaggtgaggagaaggagaaaggagcagtcagggagggcttcctgaaggaactgaccagacttgagcactgagggcccagccagggctcagcatccccttacccacccctgcccctgcgccctgccccaccgggaccccctaggctgggtgcttccgcttgtctcccaggccagttcccagctgacacccccattcccacttggttgtgtggccctcccatagtctcaagctgggtttgctcaggctcttgggctgtgccgtacagacggggtgcctgggcttgtctctctgccctgccttcgcactctacctgggtgtccttctcaggagccctcatgttttcaggaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctcaccaggtctgtacagcctggctctgagaggctctgtctgggtccgggactgtggatgtgtgtggggagtcaggcccaggctctgtggggtctctgcgggggtcacttggcccatccttccgggggcagctgtgcgtgtgagctgggcagggtggggtgcatggacgtgacttggccaagtggtcctttcccagctgccactcccccttcctgccaccctgcctttgcccaggctggtccctcctccagacaccctctgcccatctccttacctcctgcgccttcattctggagcttgaagtcccctcccccaggcagccctccaacccctggatgagcatgctgcccctgcttaactctttagtcctcacagtcccgtcccagttgctgtctggttttctgtcaccccagtatcgctgcacccggcccccctctcaggccagggccacaccagggctccatagggctgcggaagcctgtgagtgtcaagggggcttcacactctggtggtgagcccctggggaccattccagcccctgctctgcctgaagctcctgatgcagcctccaccgtgagccaggccaccctgtaagggaagaggtgagctgtgcctgcctggttgcacagcctgggcaggtgggcgggtggggcgggccctgctgctgcccggtgggggtggtgctccaaggccaagggcagcctcgtgccttctttcagctggggctgaaatcgggggtgtggacccctggcccccatcatgtgtgcatgcactggcctgggatggccagggactccctgctgctgcccccagcccctgaccccttcttgctgggtgtgaggagcatgggggctgcctccctccaggcctctctacctgcccaggtgacggttccttttgtccctctgtttggctggcctctggactggagccccaggagggcaaaagcatgaccccagagctggcccttggcacctgggcataccccaggctcctcagcctggttcccaagcctggctggtactgccgctggcatccttgctgtcctcaccccgacacaggtgtgcctgggccttgcacaacaaggtgacgccatgcgagcgtggcagggccggggaagcctttgctcctcaccctggtgaggcccatgaggggctgcaggtggagggagggtggcaccgggccccagagccaggagcccctgctgtccccggatggccgagacccttggagggccttgggagaggcggtggggcatctggacaaatgcctggtgcaggtgagaaggggtgggactacctccggcatccctgggctgagcccacctggtctccccggttgctcctgcacacggcagtgcccacctgcttccctcagctcctgaggggctgggcagagcctgttgctcacgccaccccactcagtgctgctccgggttgtgaaagctgcaggtggctcacgttagcccacatggcagcaccctcccagagcaggtgccaacctgccagtgtagacacaccgactgatgccgggggtgagtgtcctgtagtgtagaaacgcccactcatcctgcttgtcccgcagagagcatttgtcaagctggcctttctccaactgggtcactgatggagttcggcagagacggcttgggggccacgggctgggcagatggggagagctcctcacaaggctgggcagccagacccccattgtcagtcccctccaaaccctcgtgggatgtagggccctaccacagggagccccgggactgggccagtgtctcaggaggctgtgaagagtcataggcttgagtctgggagctttctcgggggccgttttgtgccccttggggagaggccagaggggccctgggtaaggggactcctctagaatcacccagaagtggcaggaggtgcagggccactgctcggggctccctgggctctgagctgggcagtgacctggccccaaggcctctggctctctggcgtgcagtgggaacagccgggacagacaggcttggagcgttcgtgtcctgcgccgcgttggtgtgtttcgtccccactgtgcctgtaggagggcaccgggtccccgtctatcctacttcatggctgaggaagctaaggcacagagtggccccgtcctgcgcccagggctctgcgttggcacagggcagagctgggctgtgaatcagggccgccttgtctcttgctgtggtgtgaggctgtgggagactcaggaatgaggcacagccaggtgcccagtgcccgtgggacccgcctccccacagtggggtggcgccgctcacacctggtaatttcacgctgggggaggccttggttcctatagcccatctcgaatcacctggatcccagggctatctctggggaacatctcctctccatcacgactactgtctttttcaccagcattttctatcctaaaatcagactcctcagctgagggccctccaggaccgcccttccccagctggaggtaaccagatttctcgtgtatgctaggaagttccccttctggtcacacctcaatatttcctgctgctggtgggaactgcaggtgcttgtacttgtcaccttctccccgtcctctctcgtcagttcccttggatgctggacacgggagccacctgggcgaggggagcccatccaagtggctgtgcgtcgggaagagtctgcccaggactgggctagaccagaacttagaattaaggagtggtggccaggcttggtggctcacacctgcaatcccagcactttgggaggccgaggcgggtggatagcttgagcctaggagtttgagaacagccaacatggcgaaactctgtctcttaaaaaataaataaaaacattagccaggtgtggtggtttgtgtctgtggtcccagctacttgggaggctgaggtgggagaatcgcttgaactgggaagatggaggttgcagcgagccaagatcgcaccactgcactccagcctgggcaacacagcaagactaggtctcaaaaaaaaagaaaaaaaaaaagaaaagaagagaggtgggttcttcttgcccatgcagttgtgttgggggaggagctcccaagctcctgttcttgatctcaagctcccctatgcccacttccatccccacccccatgccgcagcccctcggactccacacccaggcactgagacccacagatgcagcgatggcaaggcctgtcatcccttctctaccaccaagagctgtgcaatccccagaagtcactgtccctccctgagcctcagtttccccaactgcaaaatgaaaataacaaaacctttctgattccctttccagggtggctgcggtggttgagccacacgcggcccatgtggaaatgtctggggggtccctcagatctggtggctgtgttctggtctggggctcaccttggctcctgagcacttggctcctggctggctgggcgggtggtgggatggcgtgtcaccgccctgcactggaatgaatggtcaccaccctgctgcccaaccccatacagacacactaatggctccagacttggggcaagtgctgaagggggctctagggtatttcctagagcctgagccctcccctcagctgccatgttctgctgaagcagagtccctgggaggcgccactggtcaggcctggacacctccaggtgactaagtgggtaggaccggcagggccagctgcgccaggacgttcggggctgggctgtgagtggggggagcgaggctcaggcccttgctgcgtgagggggtagggcgtccctccccccgcgtgggaaatgaggaggcaggtacggggctacccctgtgggctgcggggtgggggttcagggtctgagaagcagaaacctccctccctccagtttcactttctctttacccctccccttccccctcccacgaagttccctttgaagtgagaggggctggggtgggtgtgtccagcccagcccccacacccaccggagagctagcgcggccctgggctcctgtcgggcgctggtcctcacctgttccggccaccctgggcctcgacccggccaaggtggagccccgggccctccgtgcgcccgagcacccccggcccagacgagacggttcgggcgtggcccggcggggacccagaacccgggaggccaggtgcgcccaggccaggcgctggaggctggggcgccggatggggcggggcggccgctgagtcagggccacccccgcgcgggcgcgcggagcaggtccccgggccgtggaggatcagtcgcgggacctatgggcccgggagccgccccgcccggaaaaaccggtcgggccagcgcggcgcgggcacattccggcgccgggaagggcggctgcgccgcataaaaggcgccgccgcgctggccaccgccgctcggagctcagccgccctgccacgcggggcccgcgggacgaggggacgccggggccagcgaggacgcggcggggctgggcttggcggctgggatcccccagcgccaggcgagggcgtctaaggcgtccggtacggcgtcggggccgggtggctgcagcagggcagggggtgcgcgaccagcggggatctgggcgcaggggccggtccccgggatccgcaggcgacgcgggcggtcccaagggcgtcgggggctcctctctccgcagctcggcgaaccgacggtgttggggactcgcgcgctgggtccagtggttcttaacagttcaacagttctgtagcgcaattgtgaaatgtttaggaccactagacccggcgggcgcggcgacagcgacggagcgtcccacgcgcggcctggagtcagagtcacagtcaggggtgcgccggcgaccaatccaggggagcccacggaccggctccgcgctccaggtcggccgccccatgcgccgcgccccgcagtccccagggcctggctggctccacctgctgccagggaagaccctcggccggagagccaagtgctgctgggaggtggccgggcgtggccgggctgtgctgtgggaaccgctgggtgggggcgcgctgggttgcccacgctcctggcgcgctgccggcctggagacgccgccgccgccctcttgcaccccgagggcccgcacctcgaaactccgtggaattcccagcgaggaactggcggtgggcccgtagggttgaggagcgctccttgccctgggcttcctgggagctgcccatcaggctgccggcagccgcaccctgctgggcggccgatggttcccgctgccggctccccggagcgtctccactcactgaggccttagggagcgctgcgcggctcctacgagtgcgcgctaaactcgtgaaggacctcgaggcacaggaactgggggtggggaggaagtttgcagactacacccaggtagaggagaagcggcgcccatgatgacaggtgccttcgccggagcctccctggaacctcgtggtagctagcgcccacaggagaggtgtgcgcgtcaatctgcgtgtgaagccccgggcggccctgggagggactcagcaaagggtcgaatctgtccccacctccagccaggggccggggtcttctgcctggtgctgcctggcctgctgtgtcctctggggtggagggtccccctccagtccccacctcctcacccagtgtttagagagctgcggggagtcctgggagatgggtcagacaggcctgggtttgaggcctgctagggtggccttgggccagtcacctgccctctctgagcccgacctgcacacatagggggttgatgtgaggagacaggaggtgactgtggagggctgttccagaagagggccagcagcaggacagcaaggtcccctggccacccaggtggggggagtggagttcccgggagagcatccaccactggccagtgcctcctctgttgctcagcaaatgccattgtggccacctctcaggatctggcttcagagcttggggccgtgggagcgcccagtgggtctgtggcatcggaggggttggagtgtcttccccagctgctgcctgctgaccaccgcagccccctgtagccatttcattttacaagcacgttcccccgtgccctctgcatgggccctcagccctcagcagccccgtgagaggggctgaggctcaggtgggagatggcggctgtgtccctgttctgcggcttggaggcattctgtccggtgtgcgtctgtacaatttagactgatgacaataaacatgttccaaagcatcgctgtgtccctggggtgcttgtccttttcccccaggcctcagcgtggtttctcccttgaaagcaagccagccttttccttctaatctcagagaagcagaaatgaggatggttggtggaggggcagtggcctggtccttacccaagaccctccctcaactctgcctctggcactttggtctccagggaagcccccagcctctgccaccagctttctcgttgcagtgacctcccctgggccactgggccagaccccctccctcgggtttgagctgcactgcctcaaggagccaggctggggaaagggcttggctcccaggggccccactttcaggggctccagcctgctcccactccccccactcaccacaacactgctcccttggctggctcccactcattcccgctggagcctgtaggctggccctggggacctggccaggagaatgggcaaggtgggagggttgagggattgaagagacagaggcaccttcctccaccctccctgcctctggcacaggggaccgagagtctgtcgtgcattcaaaccccagctctatgcctacaagcaagtgaccttggcaagtcccttatcccctcggaggacctgtttcttccttctgtaggatgacgtggagctcgctggaggttcccctgacatgatgcagcacacttcctgagtgctcagcagggcagagctcaagctgtcactggagctgatgtggtgggagggccagtgggggatccttgaagaggccgaatttcagccagggcctcggaggaccaatggaaggcctcaggtggcaatgaggtgtggtcttacaacaggcccctacttggtccctggggacaccaggaggacaggcccctactttgctgagactagacctgtgcttcctggcaccccagcccctccactccggcctctccagcctctgcccctgacccaggtggaggatggctcctcggggtccattccttcagccatggaattcctgaagggaagctgggcacgtggggctcctgggctgctggtggagacacatgccacctctacacaggggagtgtgaacagaggcagatgcaacttctgggtggaactggggcactgtggtgctgagacgtgccgactgtgctgctggagggccacgccggggcagggcaaagcatccctgcatgaggccgacccacctgtccaggtgtgcctgcgtgtttcctgatttggcaccgaaacgttcttggaatcttctgagtctggggcaaactgggactgctgatcaccctacgtgggaccagctcatgtacacgctgccctacccacttggacagctgaacagcttgtcttttccacaagagaaaggaaccttctgccttttaaagccagtgttattttggtctctgttaaagtagctaaaccagtatgtgaaggcaggggttctgactcactgcagaggcccaggctcagtgagtaggatgggtggcagggatctgggtcttcaccaagttcccaggcgagcctgataaatgcccaaggctgacagcagctgtcttaggcgagagacctcaggaagagagacaggctgggggaaggggagacaggtcctgaatctgcagctatgggtggtgcctggcctctactccctgggagcaggagcctagagtagaatttgcatcttagcctctctgtccttccccagaggagtccatagcgcccgctgaacaggtaacctgccaggccagggtctgggggtgcccactcgaggctcatggaatctaattgtatatgcaggtctcaggccatttgtgctgctgtaacaaaacctctgagatggataatttataaggaaccacgagaaatttatttcttcggatctggaggctggaagtctaagatcaaggtgctggcaggttcaatagcttgtgaggtctcagtctctgcttccaagttggtgccttgcgtgggtgctctggaggggagggacaccatgtcctcacacgacagaagggatgaacagcagaaaggatgggaagggcaaactcgccccctcatgcccttttataaggcacaaatcctacccatgagggtggagcactcatggcctcctcagctgctgaaggcatcagctcttcatcctgttgcactggggatgaagtttcaacatgaattttggagggtcacaagcactcaagccatggcaacatatttgcagttgagaatcatcagagggaggacagatgatggctccttcctgggtgactagataagccccatgggacagcacatctgtcacagggctgtggggtcactgtgactggctttctgagtatctttccgtggttctgaggctgcccggggagcaaagttgtgctgggagggcacacatacaagctgagttgccttgagcccgccagtctttgtcgggggtgtcactatttttcttgggtttattgaaatgccactgacctacagtaaagtgcacaggtttacagtgtacaatttgatgactcttgacatatatatgcacatctgtgaaaccatgaccacagtcaagatgataaaccgttgaccaaacacagctacctgcagggttcatccagcccttggtgatccctctttacttccccaactcctcccacccctggagttttctttgttggaaagaactccaaattcaacttatttcctagatataggaacattcagcatatctatttcttcttgagtgagttttagtgattgtttcttttacaggatttatttaatctaatgttgaatttattggtataaagttatgcatactattccattattatctttgaatatctgtagactgtggtgatgaaccatttctcattcttaatattaattatgtgttttctctttttttcttgatccatctggatagaggtttataatttttatcaattttgggaaagaaccagcttttggttttattgattttctctattgtttttctgttttctatctcaatgatttccactctgatctttattatttcctttcttctcctgactttgacttttatttgctccctttttctagtttcttttttaaatgttttatttatttgacatataaaattgtatatatttatcatgtacaacatgttgttttgatatacatataattatggaatgcctaaatcaagctaatcaatatatgcattactttacctacttatctttttttgtggtgagaacactttcttagcaattttcaaaagtacaatacattgttattaactatagttaccatgttatacaatagatctctagaacctattcctcctaactgaaattttgaatcatttgaccaacacctcctcaacttctttttcttaaggtagaagctgaggtcactgatgacctttcatcttttctaatgtagtcattttattgctataatttccgtctaagcactgctttagctccattatacaaatgtagatgtagtgtgctttcaggttcattcactttaagatacttgctaattcccgttttgaatttttctttgacatttggattatttagaattcccttcccttaccttctcttccctcccctcccctccctccttctttctttctctttctttctttctttctttctttctttctttctttctttctttctttctttctttctctctctccctctctctctttctttctttccttctttctttctttccttccttctttctttcttcttttctttctttttcttttcttttctttctttttttgacgagtctgagtctgtttcccacattggagtgcagtggcacgatctccactcaccacaacttctacctgccaggctcaagcaatccttccacctcagcccctgaagtagctgggactacaggtgtgtgccaccatgcctggctaatttttgtagtttttgtagacatggggttttgtcatgttacccaggctggtctcaaactcctgggctcaggtgatacaccagccttggcctcccaaagtgctgggattataggcatgagctgccacacctggcctgggagtgtataatttttagtttcaaaatatttgggaattttcatagtctgtttctgatattgatttctaatttaattccatcatagtcagaaaccatactctgtattacttgagtcctattaagtttattggacttgttttatggcccataatatgttttattttggtaaatgtactgaaaaataatgtgtattttgctgtcattgggggcactgttctacaaatgtcaactaggttaagttggttgatagtgttgttcaagcccactgtatccttacaattttgtgtctagctgttttatcaattactgagagaggactgttaaagtctccaactataactatggatttgccatttctcctttcagttctattcatttttgcttcatgtgtttctggacctctgttatatggtgaataaacattgataattcttatgtcctcttcttgaaataagccttttaccattatgaaattgctttcttttttttttttttttttttttctgaggcagagtctctctctgttgcccaggctggagtgcagtggcacgatctcagctcactgcaacctctgcctcccgggttcatgccattttccggcctcagcctcccgagtagctgggactataggtgcccgccaccacgcccagctaatttttttgtatttttagtagagatggggtttcaccatgttagccaggatggtcttgatctcctgacctcatgatctgcctgcctcagcctcccaaagtgctgggattacaggcatgagccactgtgcctggcctgaaattgctttctttatccttgattatattctttgctctgaaatttcttttcttttactacattaaagttgttccagtgtcttctggcttgcattatttctgatgagaacaatgctgtcattcttatctttgttcatttgcatttaatatgcctttttgttattaacataggcattccagctttctttcgattagtgttaatgtgtttctttttgtatccttttacatttaacctatttctctttttacatttaagcattttttttgtaggtagcacatagttggatcttatttttttatttggtcagacaatctctgtcttttaattgagatatttagaccatttacatttactgtgattatttacacatttgaattttgatctgtcatcttgctctttgttttctttctgtcctattcatttttttgttctccatttatttatttttttgccttcttttggattgatggactattttatgattcaaatttatactctttgttgtcttattagctacaactctttgatatgttttttcattgtttgctttaggacttacatatacatctttaacttatcatattccattttaaaataatattaatttatgtacagtgtaaaaaattatgtatagtattagaatcttgcagccttatagatacataacagtacacttccatttctccctcccaggctttgtgctattgttattcttcattttatttctatatatgttctaagccctacaatatagtgaattttttctttagtcagttatctcttaaagagatgtaaaaatgagagaaaaaagattttattttattttatttagtttttgagatgaagtctcacaatttcaggcaggctggagtacagcggtgtgatcttggctcaccgaaacctccacctcccgggttcaagcgattctcctgcctcagcttcctaagtagctaagactacagttgcgcacaaccatgcccagctaattcttgtatttttagtagtgatggggttttgctatgttggccaggctggtcttgaactcctgacctcaggtgatccacccgcctcggcctcccaaagtgctgagattacaggtgtgagccccacgcctggacaaaatattttatttttgccagcatgtttaccatttctggcgctcctttgtgttgatccagatttccatttggtataatttgctttatgcctgtaagacttctttaacatttctggtagtgcaggtctgctgttgataaattattcaccttttcaacgtctgaaaaagtcttaattttgcctgtggttttgaaacatattttcattggccatggaattctagatcaaaagtgtctttttctttcactgcattaaacttgttccagtgtcttctggcttgcattatttctgatgagaacaatgctgtcattcttatctttgttcgttgcattcaatatgcctctcctctaccacgtagttaagattttatcacttgttttcagaaatctcattatgtgccttgatgttttcttcatgtttcttgtgcttgaggttcattgagattcttggatgtgtgagtttacggttttcaccaaattctgaaagttttcagccattatttctttaaatattgtgcacaaacccctattccttttctggcattttcattacatatatatcaggccacttaaagttgtcccaaagatcactgtagctctgttcatttttaaaaatagtttttttgggttttcttgtttcattttgaatagttcctattgctatccaaataactacttcttctgcagtgtctaatttgctattaattctatccagtgtaattttcatcctggacattatattctccatctgtggaagtttaattaggtctgttttataacttctcaatgtttccatatcctcttgaacatattaaaatatagttataaaaacagatttaatgttcttgtctattaattacatcatctgcttcatttttgggttctacagataggtttttttcttctcatcatgtatttttctgtttctttgcatgcctggtaatttttgttggttgtcaaacattgtgaattttacattgttgggtgctggataatttcatttcctataaatatttgtgagctttgttcggggacatggttaaattacttgcaaatggcttgatccttttgaggcttgcttttagctctgttaagtgggaccagttcagcctttattatgggactaatttttccccaacaatgaggcaacctttctgagtagtctacctcatgtcttctaaatgataagatttttccttctggttggtgggaacagaaactattcacaccatgggttaattttttttttaatttaaaaaattttgatgaaatacataatgtaaaatttaccattttatccatttttaagtgtacagttcatggcattaagtacactcacatggttgtgcaaccacctgctaccagctagctctgtaacttttcatcttcccaaactgcaactctctacctcgcaaacaataactcctcatttccccttccccagcccctggcgaccatcattctcctttctgtctctatgaatttgatgactctagggacctcatctaaatggaatcctgtggtatgcatccttttgtgactggcttatttcacttagcatagcaacttcaaggttcatccgtgttgtgctgtgtcagaattttcttcctttttaaggctgagtaatattccattgtatggctataccacattttgtttattcatctactggcagacacttgggttgcttccatctgttggctgctgtgaataatgctgctatgaacataggtacacaaacatctgctttagctcccagaatggtgtggaatgtgggcagctttccctcagctccttttaggtggttttatccaaagccatgggtaatttatggatcctcatgagttgatccatactcagctgaagattcaaggggcactctctgcagatctccagagctaagcttttgtgcaaactctattctgcattctctagccaccttggtcctaccagactcaactgtgtctcctctgtttaggggcacctgtgggcccctcctgggtcctcccttctcatgctgaggcctgtcctctctccaggctggggcggtcagggctcgcctttgttttcctgctctcagggatcactctcctgtcctgcctgatagacaatgtctataaactggtgtttcatatgctttttccaatgtttaagttatttctggtgggagtgtaaatctggtctctgttactttatcttggctcagagtgaaagtccttacccatctccttattaccccaagaacactggctcatactcctacctgtggactgttgacattttttttaaccacattccttttcctgagacatttgtggttgtctccagcgcctgccaatgttgttgcaggtacgccctggtggcctctgccacaccctctgttaggccttcatttggaaccagagctctgccagactcctcacaccacctgctgcattctcctgggggctcagacgtaccaactggctcagggatgggacgtgtgctcacccatcataagcaagttgtatatatatgtaccatttcatatactcacacagcttccctgaaggcttggggtcagcagaagtaccatgcaggagaggtatctttagaagtgtccgcttgatgatgtctgagtaatacagccaactcagacccttttttttttcttcttgagacggcatctcactctgtcgcccaggctggagtgcagtggcaccatctcggctcactgcaagctccgcctcctgggttcacgccattctcctgcctcagcctcccgagtagctgggactacaggcgctcgccaccacgcctggctatttttttgtatttttagtagagacggggtttcaccgtgttagccaggatggtcttgatctcccgacctcgtgatccgcctgcctcggcctcccaaagtgctgggattacaggcgtgagccactgcgcctggcccaactcagtcccttctgagggaactctccaggtatttctctcccccacctcactccctgccagccttcctttagttccagttaaaattttgcccaaatcatcctcctgactgaatagtttattggaaagacatgccaatacacaggttaagcaacgctccatagctaaggtagcacagaggaggacattttgcagtctggcttatttagtctttacatttattaatttttttttttgagatggagtctcactctgtcacccaggctggagtgcagtggcacgatctcagctcactgcaacctctgcctcccaggttcaagcgattctcctggttcagcctctcgagtagctgggattacaagtgggcgccaccactcccagctagtttttgtatttttagtagagacagcgtttcactgtgttggccaggctggtcttgaactcctgacctcaggtgatccacctgcctcggcctcccaaagtgttatttagactttattaatactccttcttgcctcctagtagacacatgtaaggatttaattttcctttgagaaccactttggtctcagaccacacatggtgatatgtggtattcactgactcgctttctttacaatttccattgagacctcttctaggaattactcagaagtatatatctacatatttaaattaaacaaataattactttaaaatgaaatttaaacagtatataatttaagaagtcaaatgctcgtcaatgttggaagaaaaacagaagcctcctgccccacctattcctaccccaagttccacttcttggcagtgacctcttttagctgcttctcctatttacttctgtattccaaataacccacttttcctgcaatttttacttttcagttttatgtcctttctagggatctactatggaagctgaagattttatatcactctgaccattttctctgtccacgctactcctatccttcttatagcttggtcacaatgtttgattaaatcagcattcagagttcacattaggattgtgagctatgtaaagatcattcacagctgagcgtttcagcatctgtgatcacagttcttttccgatatagctttaaacttaaacatggttttattttaaaattggcgtaattattttttgtattatgaataattcccatgctctttgattttttttttttttttgagatgggatcttgctctgttacccaggctagagtatagtgatgtgatttttagctcactgcaagctcaaactcctgggcttaagcaatcctctggcctcagcctcctgagcagctgagactacaggcccacattaccatgcctgactaattttagtcccttcccttcccttcccttcccttcccttcccctcccttcccctcccttcccttcccctcccctgccctccccttcccttccttctttctttctgtagagtcaaggtgttactatgttgcccagggtggtcttgaactcctggccacaagtgacccttctgcctcattctcccaaagtactgagattacaggcataagccactatgcccagccccatgctctttgatagaagtttaaatttcttctaaatgtgttaaaatacatgaagtaatctaattccttcctttttttccttctctctacctgtagagagtgcttaatgcttgctccaatatgaacccgttgggactgccgttcagtggacatccttgatctccattcaccactttcttgggttagctcccatctccttgattccacatcctctttttccttggtttagtttcttgctgtgggggagcccattatccaagaacttaaagaaagagaaaaatcaaaggcaaacctttttgtctttacttttatgctaagctgatattaatagtttagctgggtatagaattctagacagggaatcattttccctcagttttggacactgaaatccatcatcttctagttttcattgtttccattgagaagtcagatgtcagttggcttcctgatccatcctcctcctctcacccccagaagcttttagtatcttctgttttttcctggtgttattttgaaatttcaagatgttggccttttcttccccgctttcttgtgctggccattgaagatttctagctcttggttctgggcaaatgttttggcattattccttcactcatattttttctatccttctcaggaactcctgtgattcagatgctgaatttcctaactctgtaattcaaaaaatgctcccatcttattttccaactcttttttctttactttctgggaggtttccttaattttatctttcaccctctttcttgaattttatttgttattatatttttattttccaagtgctttttaaagtgtcctctgaattgcatctgcacttaagttcatggaagtcaatattttctttctctgaggaaattccacggtcatgctcaggactagttgtggagatgccatatcctgttaggccctgggtggcagctcctgaagtgtgtggtgtctttggtgtggttaatggtgttgcctggaccccagggtctgagggagtggcactctcagcattcccatcttcactgattcagcacctcactctgtgtggtgcatcaatgctctacactctcgtgtaagccatattcacacacacacacacacacacacacacacacacacacacacacacagcctctactcatgaggctgccttcatgcccagccctggtccctggggatccggagctgagggaggctgggggttttgtatgaggttcacccccaggctcttcaggaagcagcggggccacttctggcatggtggcggggctgtctaggcaatgcacctgtgctaaggggtttctcaaagttttgcagattgcaccttcagccaaagtgcctggggactcggtaagactcctgacccaggtgttcttcttccccggtcactgcctatcctcaagctggaggctgagcccagcctacaaggagtagagggagaagaggcaggaacaggaggggagaaggaagtcaggggtatggggttagatgcgccaaggcctgttaggtggagtgggggcactggtgaggccacagggctggcctcatgggccttgaaggtgagccctgggctccatgccctggtgcacccttcactgtctctgggcctcagttttcctatctgcataaaaggggaactggaccaagagagtgctttaatcgtcctctggccacaaactgtggccaaagtgtgccatctgctggccacaagtgacagtgtccccattcgagatgtggctgagggaggtagagactctggagtcctgccagggcttgggtattgtgggcatggagggaggttcaggcagccagatcccgtgttggaggggagaggggagccaagcacggcgggaaaagatccaggctgcgggccttgcaggctgggcttggggccagggctctccaccctggtggggagggcactggctggaaggtttggaggccacttggtgctacacacgtcctcccaggaaacagagaaggtgcaggtaggtcaggaatgcttccacctgggcccaggaagagtcctcaggctggggcagctgggcgccgcacactggcttgcaggtcccatgaggtcaacctggctgacttagggctgggctgtgggaacccgggcaaggcatcctgagggtggggtctggcactgcagcctcgaggtgcagtgtggtggggggtgagaggagccagggtggggccagtgaggtggccagagcagaatatagggtgggggcatggcagggccgggaaaggctgggataggaaggacaggagcccctctgcagggggaatgcagcaggacctggtggcacagagaacaagcctggggttcatgcattcctttatttcttccacaaatgtgaatgagcttcagtgctgtgccaggtgctcaaccaaacatttcctgccctcatggagctgatattctaaaggggatgaaggacaataaactagacaagtaagaaacatctaagtcagctcctggtaagtgctaaggagggagaggaaacatgggcaaagctgcaggatgcaggaagggcctgacattttaggtaaggtgggcagggaacactttgcttagaaaaggcctggtggctcacgcctataaccccagcactttgggaagctgaggcaggaggattgcttgagcccaggagttcgagaccagcctgggcaacatagtgaaacctggtctctacaaaaaaatcaataagttatctcagagtggaggtgcgtgcctgtggtcccagctactcaggaggctgaggtgggaggatcggttgagtctgggaggtcgaggctgcagtgagctgtgattgcgccactgcactccagcctgggcgaaagagcaagaccctatttcaaaaaagaaaagacctggagaaagtcaggcatgtggatgtctgggggaagagccccctggcagtgggaacagtggagcaaacgctcaaatgggggtgactgcacgtttgggaacagcgaggaggcccttggggctggagcagaatgcgtagggggtgcagagcgggaggagacgggtcagtcagccagggccgagaagtggaaggagcccaccgccttcttaaaggctcacctggcggctgtggtgaagcaggcatggcattgcagaaccccctccaggggctgacattccattagggtggtagggacaggagatcctgatggatgggctgcgggggccgtgagcaagcaggagtcaaggacgactccaggatgactgaattgaaagagtgaatgagcgaggccgggcgtggtggctcacgcctgtaatcccagcactttgggaggccaaggcgggcggatcacgaggtcaggagattgagaccatcctggctgacacggtgaaactccatgtctactaaaaatacaaaaaattagccgggcatggtggtgggcgcctgtaatcccagctactcaggaggctgaggcaggagaacggcgtgaacccaggaggcggaggttgcagtgagctgagattgtgccactgcactccagcctgggagacagagcaagactccaaaaaaaaaaaaaaaaaaagaaagagtgaatgagcaaatgagtgatggagagcttgacaccccaggacactcccccatcccccttcccctcgcctgcagaagccccctcctggtgctggccaaggtgctgaagccgcgtcctaggctgtccctctgtgctggacctggggctcctctggcacagggtgaggtctgtggagccatcagctgttgaccagcgagcatccccagtctctccctactcagcaaacccttagccaggatccgtgggatcctggctgggctcccagacctcagttcagagctgaccacccttgttcgtgctccatcctggctccgaggccagggctggggtcccttgctctgcagctgggccctgggggaagagggaaggaggctgtaaacacagggcttaggagcacagactcctggggcgaaacctggagactgacctccccactctgggcctcatttcctcatctgtaaaacggcgatcatacaatacccgtgcctagcactgttgggcagattaaatgagtggatgttaccaagtgcgtaagacagagcctggtccggagaacaggtgggtgtcagctaaaccccatggccggccaccctcccccaagcactcagacaccctctgaagaactggtgcagtgaccacctgaagcctgccc
